United States Patent 9,441,233 (TRANSGENIC PLANTS HAVING INCREASED BIOMASS) - sequence listing, part 2

SEQ ID NO: 2324 - protein, 279 aa, Zea mays
  misc_feature (9)..(142): Pfam Name: DUF640 Pfam Description: Protein of unknown function (DUF640)
  misc_feature (1)..(279): Ceres Clone ID no. 298827
  misc_feature (1)..(279): Bit score of 346.4 for HMM based on sequences of Figure 32
  misc_feature (1)..(279): Functional Homolog Of SEQ ID NO. 2271
MQMQVGGGAADSPGAAAAAGAEAPRPSRYESQKRRDWHTFGQYLRNHRPPLELARCSGAHVLEFLRYLDQFGKTKVHAPGCPFFGHPSPPAPCPCPLRQAWGSLDALIGRLRAAFEEHGGRPEANPFGARAVRLYLREVRDSQAKARGIAYEKKRRKRPSASSQSSPQAATTPSLQAPPVSTPALSDAAAERADVRAHVPDAGHGHQHQHHFFMPHPQFLHGFRLLPGNPEAVAGNGNGDGSSSSASVAAGSGDEIALAMAAAAEAHAAGCMLPLSVFN

SEQ ID NO: 2325 - DNA, 717 bp, Populus balsamifera subsp. trichocarpa
  misc_feature (1)..(717): Ceres Annot ID no. 1442133
  misc_feature (1)..(717): Encodes the peptide sequence at SEQ ID NO. 2326
atgtcagctgctgttgccgccgccgccgccgcggccatcatgtcatgtaactctgcgaggagtagtggctcgtcaggagcttctaggagccaccaattgcagaaaggactgctactaccatcaccatcaccaccatctccaatatcaataccacttccattgagtcgttacgaatctcaaaagcgacgagactggaacactttcggacagtacctgagaaaccacaggccaccactggcactggcacggtgcagtggtgcccatgttttggagttcttgaggtatcttgatcagtttggcaagaccaaggtgcatagcgaaaattgtccattttttggccatccccatccaccgtgtccttgctcttgccctctcaagcaagcatggggcagccttgatgctctcatcggccgtctccgtgccgcctttgaagagaacggtggactgcctgagacgaacccttttggtgcacgcgctgtgagattgtacttaagggaagtgagagatgcacagtctaaagctagagggatagcttatgagaagaagaagagaaagaacccaacaccacaacagcagcaacagaagttacaaactgcaggaaatggtacttatcaagttcaacagggtattagtaatggtggatatgttgttccaagaaatgccctctctgacgaggctgcagtgctcggtgtaggagatgtgcctgtgttcaactaa

SEQ ID NO: 2326 - protein, 225 aa, Populus balsamifera subsp. trichocarpa
  misc_feature (25)..(157): Pfam Name: DUF640 Pfam Description: Protein of unknown function (DUF640)
  misc_feature (1)..(225): Ceres Annot ID no. 1442133
  misc_feature (1)..(225): Bit score of 348.5 for HMM based on sequences of Figure 32
  misc_feature (1)..(225): Functional Homolog Of SEQ ID NO. 2271
MSCNSARSSGSSGASRSHQLQKGLLLPSPSPPSPISIPLPLSRYESQKRRDWNTFGQYLRNHRPPLALARCSGAHVLEFLRYLDQFGKTKVHSENCPFFGHPHPPCPCSCPLKQAWGSLDALIGRLRAAFEENGGLPETNPFGARAVRLYLREVRDAQSKARGIAYEKKKRKNPTPQQQQQKLQTAGNGTYQVQQGISNGGYVVPRNALSDEAAVLGVGDVPVFN

SEQ ID NO: 2327 - protein, 220 aa, Vitis vinifera
  misc_feature (30)..(162): Pfam Name: DUF640 Pfam Description: Protein of unknown function (DUF640)
  misc_feature (1)..(220): Public GI ID no. 225444171
  misc_feature (1)..(220): Bit score of 343.6 for HMM based on sequences of Figure 32
  misc_feature (1)..(220): Functional Homolog Of SEQ ID NO. 2271
MSAAVAAAAAAANSGSRCNSANSSSSGNENSLLSRQIAVTQPLQPPSRYESQKRRDWNTFGQYLRNHRPPLALNRCSGANVLEFLRYLDQFGKTKVHTQMCPFFGHPHPPAPCPCPLRQAWGSLDALIGRLRAAFEENGGPPETNPFGARAVRLYLREVRDAQAKARGIAYEKKKRKRPQQHQESSSSTDLNSTQPNGGLVMVDSSDHGRPSMIPLSVLN

SEQ ID NO: 2328 - DNA, 1184 bp, Zea mays
  misc_feature (1)..(1184): Ceres Clone ID no. 1386592
  misc_feature (1)..(1184): Encodes the peptide sequence at SEQ ID NO. 2329
gtgccacagtccctcccctcttccagtctcgccgccaattagtactcaccccctcccttgcatccgctcccctcccccctcctctcttccccccccgacctcggcgccgaggcatgctgttgccgtgagtgagcaagggatctttccggcgatcttggaggcggcgagcctggtgccgcatgctggctgtccggccggccggaggctagctagctctcgcctctcgaccgagaagtgaagtgaagtgaagcgagatggacctggtgccgcacccggacagcccgcactccgacaacagcggcggcggcggcggctcggcgtccggggcgctgtcgccgggggcgtcatccgcgggcgcggcgtcggcgctggcgtcgccgagccggtacgagtcgcagaagcggcgggactggaacacgttcgggcagtacctgcggaaccaccggccgccgctgtccctggcgcgctgcagcggcgcgcacgtgctggagttcctgcgctacctcgaccagttcggcaagaccaaggtgcacaccccggcctgccccttcttcggccacccggcgccgccggcgccctgcccgtgcccgctccgccaggcgtggggcagcctggacgcgctcgtgggcaggctgcgcgccgcctacgaggagaacggcgggcggcccgagaacaaccccttcggcgcgcgcgccgtcaggctctaccttcgcgaggtccgcgaccatcagtcccgcgcccggggcgtcagctacgagaagaagaagcgcaagaaggccccggcgcaccccgtccctgccgccgtcatctcctcctcccacgacggcaacgggcaccactacgagcaccagatgccgccgccgccgccgcccggcgccgcggcttgactggccagccggccggccggccggagctcccggtcccggcgcggccccatgtatgctactaccacatgcactactattagccgatcatcttcttggtcggtgcctctctatagctagctgaagctcctgtgatcgactactatatatctattgcctctatctagttcttggctcctttctactatcgatctgtggctatagtttagctgccactactgctagtacaactgctgctgctgctacaaattactcccgttgctctttcaaatatgcttttgctgctggtattgctactgg

SEQ ID NO: 2329 - protein, 210 aa, Zea mays
  misc_feature (26)..(158): Pfam Name: DUF640 Pfam Description: Protein of unknown function (DUF640)
  misc_feature (1)..(210): Ceres Clone ID no. 1386592
  misc_feature (1)..(210): Bit score of 328.0 for HMM based on sequences of Figure 32
  misc_feature (1)..(210): Functional Homolog Of SEQ ID NO. 2271
MDLVPHPDSPHSDNSGGGGGSASGALSPGASSAGAASALASPSRYESQKRRDWNTFGQYLRNHRPPLSLARCSGAHVLEFLRYLDQFGKTKVHTPACPFFGHPAPPAPCPCPLRQAWGSLDALVGRLRAAYEENGGRPENNPFGARAVRLYLREVRDHQSRARGVSYEKKKRKKAPAHPVPAAVISSSHDGNGHHYEHQMPPPPPPGAAA

SEQ ID NO: 2330 - DNA, 1419 bp, Populus balsamifera subsp. trichocarpa
  misc_feature (1)..(1419): Ceres Annot ID no. 1467194
  misc_feature (1)..(1419): Encodes the peptide sequence at SEQ ID NO. 2331
atgtcagctgctgttgccgccgccgcctctgcggccactatgtcacataattctgcaagaagtggctcgtcaggaactcctaagagccaccaattgcagaaaggagtgctattaccaccatcatcaccaatatcatcaccactaccattgagtcgttacgaatctcagaagcgacgagactggaacactttcggacagtacctaagaaaccacaggccaccactggcactgtcacggtgcagtggagctcatgttttggagtttttgaggtatcttgatcagtttggaaagaccaaggtgcataaccaaggttgtccattttttggccacccccatccaccatctccttgctcttgccctctcaagcaagcatggggcagccttgatgctctcaccggacgtctccgtgctgccttcgaagagaacggtggactgcctgagacaaacccttttggtgcacgcgctgtgagattgtacttaagggaagtaagagatgcacaggcaaaagctagagggatagcttatgagaagaagaagagaaagaacccagtacagcagcagcagcagaagtcacaaactgcaggaaatggcacttacagccatgttcaacaaggtatttgtaatggtggaactgatggatacgttccaagaaatgtcctgtcaaatggagctgctgtgattaatgttggggatgtatgtttaagagagaaagccatcattttctcctattttggatcctatggtaaccaggaatcatcagttaatcaaaatgtttgtgagattttcctaagatttagacagcacagagactatggatatgttttcttacctgaattgtatgtgagcgcggccgcactgtgtggctcacctgtggaaaaaaaatctagaatgctatcacagacagctggttcattaaaatatatgctccagatcagaatcaaattaagacagaaaggtgcaaattatgctgcaataaagggaattgttgatccccggatgtctttgtatcaactacggagtaccactgctcatcagatacgaaaagaatttttgcagacatcatgcatctttgtcatatacataatgaatatatcaaggacaaacaattcacaagttcaattcagaatggcaaggaatgtcacggagagaataaagtacaccacggactttagtctcaataccagttcaggatatggtcatgtttctattaatttttttctggctacagaagagcatgagaatttatcaacaagaacatacaggaatagggcattctttcttctatatgttgcacaccaaagcaatgacgtcaaaatcaactacaaaagttctgtgtatatcaacagacttctaatatctatgctattgatcatcctaacctcagttccaaattcaagtaggacgccaaacttagcatag

SEQ ID NO: 2331 - protein, 472 aa, Populus balsamifera subsp. trichocarpa
  misc_feature (34)..(166): Pfam Name: DUF640 Pfam Description: Protein of unknown function (DUF640)
  misc_feature (1)..(472): Ceres Annot ID no. 1467194
  misc_feature (1)..(472): Bit score of 347.7 for HMM based on sequences of Figure 32
  misc_feature (1)..(472): Functional Homolog Of SEQ ID NO. 2271
MSAAVAAAASAATMSHNSARSGSSGTPKSHQLQKGVLLPPSSPISSPLPLSRYESQKRRDWNTFGQYLRNHRPPLALSRCSGAHVLEFLRYLDQFGKTKVHNQGCPFFGHPHPPSPCSCPLKQAWGSLDALTGRLRAAFEENGGLPETNPFGARAVRLYLREVRDAQAKARGIAYEKKKRKNPVQQQQQKSQTAGNGTYSHVQQGICNGGTDGYVPRNVLSNGAAVINVGDVCLREKAIIFSYFGSYGNQESSVNQNVCEIFLRFRQHRDYGYVFLPELYVSAAALCGSPVEKKSRMLSQTAGSLKYMLQIRIKLRQKGANYAAIKGIVDPRMSLYQLRSTTAHQIRKEFLQTSCIFVIYIMNISRTNNSQVQFRMARNVTERIKYTTDFSLNTSSGYGHVSINFFLATEEHENLSTRTYRNRAFFLLYVAHQSNDVKINYKSSVYINRLLISMLLIILTSVPNSSRTPNLA

SEQ ID NO: 2332 - DNA, 627 bp, Sorghum bicolor
  misc_feature (1)..(627): Ceres Annot ID no. 8680326
  misc_feature (1)..(627): Encodes the peptide sequence at SEQ ID NO. 2333
atggacctgtccccgaaccccgagagcccgggaggcggtggtgatggcggcggaggcggaggcggagccggtggatcgagcagcgggccgtcgtcttcgtcggcgcagggcggcggcacgccgcagacgccgagccggtacgaggcgcagaagcggcgggactggaacacgttcgggcagtacctgcggaaccaccggccgccgctgagcctcgcgcagtgcagcggcgcgcacgtgctggagttcctgcggtacctggaccagttcggcaagaccaaggtccacacggcggcgtgccccttcttcggccacccgaacccgcccgcgccgtgcccctgcccgctgcgccaggcgtggggcagcctcgacgcgctggtgggccgcctccgcgccgccttcgaggagaacggaggccgcccggagtccaaccccttcgcggcgcgcgccgtccgcctctacctccgcgaggtccgcgagcaccaggcccgcgcgcgcggcgtcagctacgagaagaagaagcgcaagaaggcgcagccgcccgatcacgccagcggcagcggaggccaaggtcctcaccaccaccacccgccgcctccggccccgccgtccgccggcgcggcgtgctga

SEQ ID NO: 2333 - protein, 208 aa, Sorghum bicolor
  misc_feature (28)..(160): Pfam Name: DUF640 Pfam Description: Protein of unknown function (DUF640)
  misc_feature (1)..(208): Ceres Annot ID no. 8680326
  misc_feature (1)..(208): Bit score of 329.2 for HMM based on sequences of Figure 32
  misc_feature (1)..(208): Functional Homolog Of SEQ ID NO. 2271
MDLSPNPESPGGGGDGGGGGGGAGGSSSGPSSSSAQGGGTPQTPSRYEAQKRRDWNTFGQYLRNHRPPLSLAQCSGAHVLEFLRYLDQFGKTKVHTAACPFFGHPNPPAPCPCPLRQAWGSLDALVGRLRAAFEENGGRPESNPFAARAVRLYLREVREHQARARGVSYEKKKRKKAQPPDHASGSGGQGPHHHHPPPPAPPSAGAAC

SEQ ID NO: 2334 - DNA, 702 bp, Populus balsamifera subsp. trichocarpa
  misc_feature (1)..(702): Ceres Annot ID no. 1469591
  misc_feature (1)..(702): Encodes the peptide sequence at SEQ ID NO. 2335
atggatttagcttccccatcaacaaaccccacctattcaagccctgtaatcaccagccccaccacccccaccaccacctccacaaacaccacaactttggccacaaccacttccccatcttccactccaagtcgctatgagaaccaaaagagaagggactggaacactttctgccagtaccttagaaaccacaggcctcctttatcactccctatgtgcagcggagcccatgttcttgaatttttaaggtacctagaccaatttggcaaaaccaaagtccataaccaaacttgtcctttcttcggcttccctaatccacccgcaccatgcccttgccccctccggcaagcatggggaagccttgatgcactcatcggaaggctcagagctgcctacgaggagcatggagggaggcccgaaggaaacccatttggtgcaaaagcagtgaggatttacttaagggaggttagggattttcaagctaaagcaagaggagttagctatgagaagaagagaaaaaggcccaaaccaaaggtcacagcaacaccacaatcagcagcagccgcagaagcagcagctgctggttccagtgcagttgatttgctctttaagggacagctgcatggtaatgaccttgtagtatcagcagcggcagtagtggagaggcattgccaacttgaagtagaagacagtattgtttga

SEQ ID NO: 2335 - protein, 233 aa, Populus balsamifera subsp. trichocarpa
  misc_feature (27)..(159): Pfam Name: DUF640 Pfam Description: Protein of unknown function (DUF640)
  misc_feature (1)..(233): Ceres Annot ID no. 1469591
  misc_feature (1)..(233): Bit score of 349.2 for HMM based on sequences of Figure 32
  misc_feature (1)..(233): Functional Homolog Of SEQ ID NO. 2271
MDLASPSTNPTYSSPVITSPTTPTTTSTNTTTLATTTSPSSTPSRYENQKRRDWNTFCQYLRNHRPPLSLPMCSGAHVLEFLRYLDQFGKTKVHNQTCPFFGFPNPPAPCPCPLRQAWGSLDALIGRLRAAYEEHGGRPEGNPFGAKAVRIYLREVRDFQAKARGVSYEKKRKRPKPKVTATPQSAAAAEAAAAGSSAVDLLFKGQLHGNDLVVSAAAVVERHCQLEVEDSIV

SEQ ID NO: 2336 - DNA, 1296 bp, Panicum virgatum
  misc_feature (1)..(1296): Ceres Clone ID no. 1790902
  misc_feature (1)..(1296): Encodes the peptide sequence at SEQ ID NO. 2337
acaccttcaaacagatcatgaagctggtggtgctcactgctctcccggccctgctgatcaccaatcaccagatgatgggcctatgagtgaaccagcagcctgcagcaactgttactactaccgccaccgccagcactgggaaagaactcaagaagccaagcctccaattcgccatcagcgagatcgagctcggctgtgctaattccacccaaagctagctgatccatggacatgtcgccgaaccccgacagcccctcgtcgggagggggcaacggcggcatcgggtcgagcagcggcggcgcgtcgccgtccgttggttcgatgacgccgcagtcgccgagccggtacgaggcgcagaagcggcgcgactggaacacgttcgggcagtatctgcggaaccaccggccgccgctgagcctggcgcagtgcagcggcgcccacgtcctcgagttcctccgctacctggaccagttcggcaagaccaaggtgcacggcccggcgtgccctttcttcggccacccgaacccgccggcgccgtgcccctgcccgctccgccaggcctggggcagcctcgacgccctcgtgggccgcctccgcgccgccttcgaggagaacggaggccgcccggagtccaaccccttcgccgcgcgcgccgtccgcctctacctccgcgaggtccgcgagcaccaggcccgcgcccgcggcgtcagctacgagaagaagaagcgcaagaagccgcagcagctgcaggcaggcgacggcagcggcagcctccacggccacccccaccagccgccgcccccgccgcccgccggcgccgcctgctgagctcgatctggtcgaccgacggctcgatcgcgcgcccaaccacgctctcctatttggccggtacgatatgccagattgagctcgagcatctacatattttatgtatcgttcagttcgcgtacgatgaatgcatgcatggcatgtgctttggcaccaccagtagtgggtgctgctgcctgcgtgtactgcattgcagcttgtgtgtttaattcgattggctttagctctggtgttgtttattagtcggtctatttgcttgtagccttgtaggagtgagcaagtgtttgctgtacttcgaataagaggatcggagtgtgtcctttgaggtctagctagggacagggagatacatatatggagatctctctagctgtttgtggaagatttgaaagcccctctgtgtttgtgtgtgtccagtgtccgtccgtctagacatgcatgtgtcaatcgattctggcaagcagcagc

SEQ ID NO: 2337 - protein, 200 aa, Panicum virgatum
  misc_feature (22)..(154): Pfam Name: DUF640 Pfam Description: Protein of unknown function (DUF640)
  misc_feature (1)..(200): Ceres Clone ID no. 1790902
  misc_feature (1)..(200): Bit score of 325.9 for HMM based on sequences of Figure 32
  misc_feature (1)..(200): Functional Homolog Of SEQ ID NO. 2271
MDMSPNPDSPSSGGGNGGIGSSSGGASPSVGSMTPQSPSRYEAQKRRDWNTFGQYLRNHRPPLSLAQCSGAHVLEFLRYLDQFGKTKVHGPACPFFGHPNPPAPCPCPLRQAWGSLDALVGRLRAAFEENGGRPESNPFAARAVRLYLREVREHQARARGVSYEKKKRKKPQQLQAGDGSGSLHGHPHQPPPPPPAGAAC

SEQ ID NO: 2338 - DNA, 624 bp, Populus balsamifera subsp. trichocarpa
  misc_feature (1)..(624): Ceres Annot ID no. 1484626
  misc_feature (1)..(624): Encodes the peptide sequence at SEQ ID NO. 2339
atggactctgttcaagacttcagcagtaccacaacacacccaataatcacaatccccctcaacaccaccaccaccaccacctccccctcctcttcctcccccatcaccaccaccaccgccaccacctccccctccactctcagccgctatgagaaccagaagcggcgagactggaacacctttggccaatacctccggaaccaccgcccccctctctccctctcccggtgcagtggggcccacgtcctcgagttcttgcgttaccttgatcagtttggaaaaaccaaagtccacacccaactctgccccttctttggccacccgaatccgcctgcaccgtgcccgtgccctctccgccaggcctggggaagcctcgatgcacttattggccgcctccgtgctgcctttgaagagcacggaggcaagcctgagaacaaccccttcggggctcgtgctgttaggctttatctacgtgaagttagagactcacaggcaaaagctagagggattagctacgagaagaagaagagaaagagaccaccacagcagcataatcctgcttccctgatgccagcacaagcaccaccagagagtactactggtgcaagtaatcatgatcagtaa

SEQ ID NO: 2339 - protein, 207 aa, Populus balsamifera subsp. trichocarpa
  misc_feature (31)..(163): Pfam Name: DUF640 Pfam Description: Protein of unknown function (DUF640)
  misc_feature (1)..(207): Ceres Annot ID no. 1484626
  misc_feature (1)..(207): Bit score of 337.2 for HMM based on sequences of Figure 32
  misc_feature (1)..(207): Functional Homolog Of SEQ ID NO. 2271
MDSVQDFSSTTTHPIITIPLNTTTTTTSPSSSSPITTTTATTSPSTLSRYENQKRRDWNTFGQYLRNHRPPLSLSRCSGAHVLEFLRYLDQFGKTKVHTQLCPFFGHPNPPAPCPCPLRQAWGSLDALIGRLRAAFEEHGGKPENNPFGARAVRLYLREVRDSQAKARGISYEKKKRKRPPQQHNPASLMPAQAPPESTTGASNHDQ

SEQ ID NO: 2340 - DNA, 672 bp, Sorghum bicolor
  misc_feature (1)..(672): Ceres Annot ID no. 8635017
  misc_feature (1)..(672): Encodes the peptide sequence at SEQ ID NO. 2341
atggacctgattccgcacccggacagcccgcactccgacaacagcggcggcgtcggcggcggtggcggtggcggcggcgtgggatcggtgtccggggcgctgtcgccggcgggggcgtcgtccgcgggcgcggtgtcggcgctggcgtcgccgagccggtacgagtcgcagaagcgcagggactggaacacgttcgggcagtacctgcggaaccaccgcccgccgctgtccctggcgcgctgcagcggcgcgcacgtgctcgagttcctgcgctacctcgaccagttcggcaagaccaaggtgcacaccccggcctgccccttcttcggccacccggcgccgccggcgccctgcccgtgcccgctccgccaggcgtggggcagcctggacgcgctcgtgggcaggctgcgcgccgcctacgaggagaacggggggcggcccgagaacaaccccttcggcgcgcgcgccgtcaggctctacctccgcgaggtgcgcgaccatcagtcccgcgcccggggcgtcagctacgagaagaagaagcgcaagaaggccccggcgcaccccgtccccgccgccgtcatctcctcctcctcctcccacgacggcaacggacaccaccactacgagcaccaccagatgccgccgccaccaccgcccggcgcagcggcttga

SEQ ID NO: 2341 - protein, 223 aa, Sorghum bicolor
  misc_feature (35)..(167): Pfam Name: DUF640 Pfam Description: Protein of unknown function (DUF640)
  misc_feature (1)..(223): Ceres Annot ID no. 8635017
  misc_feature (1)..(223): Bit score of 328.6 for HMM based on sequences of Figure 32
  misc_feature (1)..(223): Functional Homolog Of SEQ ID NO. 2271
MDLIPHPDSPHSDNSGGVGGGGGGGGVGSVSGALSPAGASSAGAVSALASPSRYESQKRRDWNTFGQYLRNHRPPLSLARCSGAHVLEFLRYLDQFGKTKVHTPACPFFGHPAPPAPCPCPLRQAWGSLDALVGRLRAAYEENGGRPENNPFGARAVRLYLREVRDHQSRARGVSYEKKKRKKAPAHPVPAAVISSSSSHDGNGHHHYEHHQMPPPPPPGAAA

SEQ ID NO: 2342 - protein, 202 aa, Oryza sativa subsp. japonica
  misc_feature (23)..(155): Pfam Name: DUF640 Pfam Description: Protein of unknown function (DUF640)
  misc_feature (1)..(202): Public GI ID no. 115459426
  misc_feature (1)..(202): Bit score of 324.5 for HMM based on sequences of Figure 32
  misc_feature (1)..(202): Functional Homolog Of SEQ ID NO. 2271
MDLSPNPDSPPSGGGNGGGGGSSSSNSSPSMGAGAPQSPSRYEAQKRRDWNTFGQYLRNHRPPLSLAQCSGAHVLEFLRYLDQFGKTKVHTAACPFFGHPSPPAPCPCPLRQAWGSLDALVGRLRAAFEENGGRPESNPFAARAVRLYLREVREHQARARGVSYEKKKRKKPQQQQLQGGDSSGLHGHQHHPPPPPPAGAAC

SEQ ID NO: 2343 - DNA, 989 bp, Triticum aestivum
  misc_feature (1)..(989): Ceres Clone ID no. 660540
  misc_feature (1)..(989): Encodes the peptide sequence at SEQ ID NO. 2344
ctaatcgaaaaaaaattctcgagccagcttcttcacctcccgccgacgccactgttgctgctggtcgacctatcttcttcgcggctctgagtccgccaccggcgaaaaagggatcggccgcgtgccgccgtgaggaaaggttgatccatggacctgtcaccaaaccccgagagcccgaatgccccgggcggctgtggcggcagcggcgccggtggatctagcggcggtggaggggcgtcctcgtctgctgggggtggaggcacgccgcagacgcccagccggtacgaggcgcagaagcggcgggactggaacacgttcgggcagtacctgcggaaccaccggccgccgctgagcctcgcgcagtgcagcggcgcgcacgtgctggagtttctgcggtacctggaccagttcggcaagaccaaggtgcacacggcgtcgtgccccttcttcggccacccgaacccgccggcgccctgcccctgcccactgcgtcaggcgtgggggagcctcgacgcgctcgtgggacgccttcgcgccgcgttcgaggagcacggcggccgccccgagtccaaccccttcgccgcccgcgcggtccgcctgttcctccgcgaggtccgcgagcaccaggctcgcgcgcgcggcgtcagctacgagaagaagaagcgcaagaagccgacgcctggtgacgccagcagcagcggcagccaccaggctccacccccgccgccaccgccccccgctggtgcggcctgctgaggaggagagaggacctgtactgcgcacgtgcccatttggtatgccggaccgatgatgagcatattttatgtaggtctcgatcgattaactgcttgtgcatgcatgcattgttttactaccattctgccgggcttaagatctagactagatgattcagacttttattgatcgtgctacgtccatttgctagttattatttgcttctgcttaatttctactgccaagctttctcc

SEQ ID NO: 2344 - protein, 202 aa, Triticum aestivum
  misc_feature (27)..(159): Pfam Name: DUF640 Pfam Description: Protein of unknown function (DUF640)
  misc_feature (1)..(202): Ceres Clone ID no. 660540
  misc_feature (1)..(202): Bit score of 317.3 for HMM based on sequences of Figure 32
  misc_feature (1)..(202): Functional Homolog Of SEQ ID NO. 2271
MDLSPNPESPNAPGGCGGSGAGGSSGGGGASSSAGGGGTPQTPSRYEAQKRRDWNTFGQYLRNHRPPLSLAQCSGAHVLEFLRYLDQFGKTKVHTASCPFFGHPNPPAPCPCPLRQAWGSLDALVGRLRAAFEEHGGRPESNPFAARAVRLFLREVREHQARARGVSYEKKKRKKPTPGDASSSGSHQAPPPPPPPPAGAAC

SEQ ID NO: 2345 - protein, 202 aa, Oryza sativa subsp. japonica
  misc_feature (23)..(155): Pfam Name: DUF640 Pfam Description: Protein of unknown function (DUF640)
  misc_feature (1)..(202): Public GI ID no. 125590992
  misc_feature (1)..(202): Bit score of 324.1 for HMM based on sequences of Figure 32
  misc_feature (1)..(202): Functional Homolog Of SEQ ID NO. 2271
MDLSPNPDSPPSGGGNGGGGGSSSSNSSPSMGPGAPQSPSRYEAQKRRDWNTFGQYLRNHRPPLSLAQCSGAHVLEFLRYLDQFGKTKVHTAACPFFGHPSPPAPCPCPLRQAWGSLDALVGRLRAAFEENGGRPESNPFAARAVRLYLREVREHQARARGVSYEKKKRKKPQQQQLQGGDSSGLHGHQHHPPPPPPAGAAC

SEQ ID NO: 2346 - DNA, 667 bp, Zea mays
  misc_feature (1)..(667): Ceres Clone ID no. 100873191
  misc_feature (1)..(667): Encodes the peptide sequence at SEQ ID NO. 2347
gtgagcaagggatctttccggcgatcttggaggcggcgagcctggtgccgcatgctggctgtccggccggccggaggctagctagctctcgcctctcgaccgagaagtgaagtgaagtgaagcgagcttgcttgtcagatggacctggtgccgcacccggacagcccgcactccgacaacagcggcggcggcggcggctcggcgtccggggcgctgtcgccgggggcgtcatccgcgggcgcggcgtcggcgctggcgtcgccgagccggtacgagtcgcagaagcggcgggactggaacacgttcgggcagtacctgcggaaccaccggccgccgctgtccctggcgcgctgcagcggcgcgcacgtgctggagttcctgcgctacctcgaccagttcggcaagaccaaggtgcacaccccggcctgccccttcttcggccacccggcgccgccggcgccctgcccgtgcccgctccgccaggcgtggggcagcctggacgcgctcgtgggcaggctgcgcgccgcctacgaggagaacggcgggcggcccgagaacaaccccttcggcgcgcgcgccgtcaggctctaccttcgcgaggtccgcgaccatcagtcccgcgcccggggcgtcagctacgagaagaagaagcgtcagaaggccccgg

SEQ ID NO: 2347 - protein, 176 aa, Zea mays
  misc_feature (26)..(158): Pfam Name: DUF640 Pfam Description: Protein of unknown function (DUF640)
  misc_feature (1)..(176): Ceres Clone ID no. 100873191
  misc_feature (1)..(176): Bit score of 283.1 for HMM based on sequences of Figure 32
  misc_feature (1)..(176): Functional Homolog Of SEQ ID NO. 2271
MDLVPHPDSPHSDNSGGGGGSASGALSPGASSAGAASALASPSRYESQKRRDWNTFGQYLRNHRPPLSLARCSGAHVLEFLRYLDQFGKTKVHTPACPFFGHPAPPAPCPCPLRQAWGSLDALVGRLRAAYEENGGRPENNPFGARAVRLYLREVRDHQSRARGVSYEKKKRQKAP

SEQ ID NO: 2348 - protein, 253 aa, Oryza sativa subsp. japonica
  misc_feature (76)..(208): Pfam Name: DUF640 Pfam Description: Protein of unknown function (DUF640)
  misc_feature (1)..(253): Public GI ID no. 47847657
  misc_feature (1)..(253): Bit score of 315.7 for HMM based on sequences of Figure 32
  misc_feature (1)..(253): Functional Homolog Of SEQ ID NO. 2271
MRGEEEPAVAAAAYTTASKAGFLFFSAALTRLPTREEEISRRLLMELSPPNHESSPPTAGGGGGGGGDGAGGSSSAGASSSAGGGAATPQTPSRYEAQKRRDWNTFGQYLRNHRPPLGLAQCSGAHVLEFLRYLDQFGKTKVHTAACPFFGHPNPPAPCPCPLRQAWGSLDALVGRLRAAFEENGGRPESNPFAVRAVRLYLREVREHQARARGVSYEKKKRKKPQPADTSGGGGHPHPPPPPPPPPSAGAAC

SEQ ID NO: 2349 - protein, 213 aa, Zea mays
  misc_feature (28)..(160): Pfam Name: DUF640 Pfam Description: Protein of unknown function (DUF640)
  misc_feature (1)..(213): Public GI ID no. 259490587
  misc_feature (1)..(213): Bit score of 327.0 for HMM based on sequences of Figure 32
  misc_feature (1)..(213): Functional Homolog Of SEQ ID NO. 2271
MDLVPQLDSPHSDNGGGGGSGSLASGALSPGASSAGTVSALASPSRYESQKRRDWNTFGQYLRNHRPPLSLARCSGAHVLEFLRYLDQFGKTKVHTAACPFFGHPAPPAPCPCPLRQAWGSLDALVGRLRAAYEENGGRPENNPFGARAVRLYLREVRDHQSRARGVSYEKKKKRKKAPPHPVPAAVISSSHDGNGHHYEHQMPPPPPPGAAA

SEQ ID NO: 2350 - DNA, 802 bp, Brassica napus
  misc_feature (1)..(802): Ceres Clone ID no. 1464359
  misc_feature (1)..(802): Encodes the peptide sequence at SEQ ID NO. 2351
agacacacgacccacacacacacacacagagattcacaagcaaaatcaagaaccctaaaatctaaagaacgtcctgacataatcacacgatcaaaaatggagggagaaaccgcagtgaaggcagcggcaagttcctcatcatcaccaagccgctatgagtcgcaaaagagacgagactggaacactttcctacagtatctaaaaaaccacaagccacctttaaccctgtctcgttgcagtggcgcacacgtcatcgagttccttaagtacctcgaccagtttggtaagaccaaagtccacgtcgcggcttgtcccttcttcggagtaccgtacccaccggctcagtgcacttgccctctcaggcaggcttggggaagcctcgactctctcatcggccgtctaagggctgcgttcgaggaaatcggcggtggtcttccagagtcaaaccctttagctgccaaagcgattaggatctatcttaaagaagtacgtgaaactcaggctaaggctcgagggattccatacgacaagaagaaacggaaacgacctcgtacagctaaggaaactcagaagcccgatgatggagaaggtgccggtggaagtggaagtggtgattctgctttggttatttctgcaactgtggtatagtccaaatataagatgctaaaactaaatataagaaaactttggcatagtaattctctccgtgttctttactttataaattttatatgttgtgtagtcgtttatttgagttgtagaatgcaattataaatggaaaagacggatcatagattattat

SEQ ID NO: 2351 - protein, 183 aa, Brassica napus
  misc_feature (1)..(134): Pfam Name: DUF640 Pfam Description: Protein of unknown function (DUF640)
  misc_feature (1)..(183): Ceres Clone ID no. 1464359
  misc_feature (1)..(183): Bit score of 335.4 for HMM based on sequences of Figure 32
  misc_feature (1)..(183): Functional Homolog Of SEQ ID NO. 2271
MEGETAVKAAASSSSSPSRYESQKRRDWNTFLQYLKNHKPPLTLSRCSGAHVIEFLKYLDQFGKTKVHVAACPFFGVPYPPAQCTCPLRQAWGSLDSLIGRLRAAFEEIGGGLPESNPLAAKAIRIYLKEVRETQAKARGIPYDKKKRKRPRTAKETQKPDDGEGAGGSGSGDSALVISATVV

SEQ ID NO: 2352 - DNA, 1533 bp, Panicum virgatum
  misc_feature (1)..(1533): Ceres Clone ID no. 1988960
  misc_feature (1)..(1533): Encodes the peptide sequence at SEQ ID NO. 2353
acctctccccaagctcgctcaactcagctgctggcctcctctcccgtccctttccaccgatcgagcttcttctaactgcctgtccatgcatgtcgtcagcttgtgttgtgtagcttctgtttccctggtgtctggtcgatcgatcgtgcgcgcacggattgtctagtggtaggctcttggccctgcgcctacagtacgcccacacatggatcaagggccctgtaaaccctgttctgcagcgacccaccgtgtcgatcattaaccgggcggcgacactctggctgttctggaatctggatcaattcgccttcgccttcttggagtaggtgcagatctgggttggccttcgtggacaggcggcggcgaaggagctatggagatggccggcgcggcggacagcccgggcctggcggcggcgcggccgaaccggtacgagtcgcagaagcgccgggactggcagacgttcgggcagtacctgcgcaaccaccggccgccgctggagctggcccggtgcagcggcgcgcacgtgctcgagttcctccgctacctggaccagttcggcaagaccaaggtgcacgcgccggggtgccccttcttcggccacccgtcgccgccggcgccgtgcccgtgcccgctcaagcaggcgtggggcagcctcgacgcgctcgtcggccgcctccgcgccgcctatgaggagcacggcggccgccccgaggccaaccccttcggggcgcgcgccgtccggctctacctccgcgaggtccgcgacacccaggccaaggcgcgcggcatcgcctacgagaagaagcgccgcaagcgccacccgccggcacacaggcaggccaagcagcagcaggacgccggccagcagcagcagcagcactaccacccccaccaccaccaccaggcgtcgcccgccgcggccgcggtgaccgagagtaggcgcgtgctggctgacatggccgaaccgccggcgccgcacttcctgatcccgcacgcgcagttcctccacggccacttcctggtgccggtcaccgagccgaccgaccccaccgcgggcatgggcggcggcggcaccggcgaggacttggtgctggcaatggcggccgccgccgaggcgcacgccgccgcggccgggttcttgatgccgctgtccttctttcactagctagcttgctgggtccactctccgctgcctctatagctccatgggcagggatgcaaggctaggtaattaggcgtaatcaagcatgcaggttttgctaatggcgatcggcctgatctctgcgcgccgtttggtcgtccatccggcttttggtgtttatgcgcagtcgtctcctccgcgcgacattgccggcggcgcttgcatcaaccgctgctgccttctggttgtattttgggtgcgtggttttgtggacgcagtgatagaatggctggattagacggctctgtgtgtttttctccatgactcggatcttgtgggaatttcatgtactacagctgatctcaatcgacttaacatttttcctggtt

SEQ ID NO: 2353 - protein, 264 aa, Panicum virgatum
  misc_feature (1)..(133): Pfam Name: DUF640 Pfam Description: Protein of unknown function (DUF640)
  misc_feature (1)..(264): Ceres Clone ID no. 1988960
  misc_feature (1)..(264): Bit score of 323.2 for HMM based on sequences of Figure 32
  misc_feature (1)..(264): Functional Homolog Of SEQ ID NO. 2271
MEMAGAADSPGLAAARPNRYESQKRRDWQTFGQYLRNHRPPLELARCSGAHVLEFLRYLDQFGKTKVHAPGCPFFGHPSPPAPCPCPLKQAWGSLDALVGRLRAAYEEHGGRPEANPFGARAVRLYLREVRDTQAKARGIAYEKKRRKRHPPAHRQAKQQQDAGQQQQQHYHPHHHHQASPAAAAVTESRRVLADMAEPPAPHFLIPHAQFLHGHFLVPVTEPTDPTAGMGGGGTGEDLVLAMAAAAEAHAAAAGFLMPLSFFH

SEQ ID NO: 2354 - DNA, 1186 bp, Zea mays
  misc_feature (1)..(1186): Ceres Clone ID no. 100871850
  misc_feature (1)..(1186): Encodes the peptide sequence at SEQ ID NO. 2355
tcaacccaccatatttatctgcctcctctcgccacatgctctcctcctctgccggctcagtcgtgggacgagttccgatcccgacccctagcttccgctcccgatccgtcgtctcatcctctcctacttgctgatctggtcgagctcgtgttcgcgcttcgcggagatcgtcaggtgaccgagcgagccatggaggtagccggcgtcgtcgcgtccgcggccgacagccctggcgccgcggcggcgcggccgagccggtacgagtcgcagaagcggcgggactggcacacgttcgggcagtacctgcgcaaccaccggccgccgctggagctggcccggtgcagcggcgcgcacgtgctggagttcctgcgctacctggaccagttcggcaagaccaaggtgcacgcggcgcggtgccccttcttcggccacccgtccccgccggcgccctgcccgtgcccgctcaagcaggcgtggggcagcctggacgcgctcgtcggccgcctgcgcgccgcgttcgaggagcacgggggccggcccgaggccaaccccttcggcgcgcgcgccgtcaggctttacctccgcgaggtccgcgacagccaggccaaggcgcgcggcatcgcctacgagaagaagsgccgcaagcgccacccgccggsgcmccgccagcccaagcagcagcagcagcaggasggccagcmccagcmcccktcgcacgccgccccgggcccggtggccgagcccccggcccccccttttttgttcccgcccgcgcccttcctccatggccatttcctggggccggcggccgagcccatcgacccggccgcggggggggggggcggccctggggatgattttgcgctggcaatggcagcccccgccggggcgcccgcggccgggtttttgatgccgctgtccgtgttcaactagctagcttgcttgcttgccccagtattttttcccccgttccttcggtttaattagcagaaatgcaagagtgattaggcccgtaagtaaacttgcgggttttgttaatggcgcccgatttggtttcggggtgcgcgcgcgatttaagtatgagatgaccctggctgtgtgccccatcttcaaccgctgtttctgcctttttgcctcccacccttttggttgtattagtgattttgcatggttttgtgtatgcagt

SEQ ID NO: 2355 - protein, 247 aa, Zea mays
  misc_feature (5)..(137): Pfam Name: DUF640 Pfam Description: Protein of unknown function (DUF640)
  misc_feature (1)..(247): Ceres Clone ID no. 100871850
  misc_feature (1)..(247): Bit score of 318.3 for HMM based on sequences of Figure 32
  misc_feature (1)..(247): Functional Homolog Of SEQ ID NO. 2271
  misc_feature (150)..(150): Xaa is any aa, unknown, or other
  misc_feature (157)..(157): Xaa is any aa, unknown, or other
  misc_feature (158)..(158): Xaa is any aa, unknown, or other
  misc_feature (168)..(168): Xaa is any aa, unknown, or other
  misc_feature (171)..(171): Xaa is any aa, unknown, or other
  misc_feature (173)..(173): Xaa is any aa, unknown, or other
  misc_feature (174)..(174): Xaa is any aa, unknown, or other
MEVAGVVASAADSPGAAAARPSRYESQKRRDWHTFGQYLRNHRPPLELARCSGAHVLEFLRYLDQFGKTKVHAARCPFFGHPSPPAPCPCPLKQAWGSLDALVGRLRAAFEEHGGRPEANPFGARAVRLYLREVRDSQAKARGIAYEKKXRKRHPPXXRQPKQQQQQXGQXQXXSHAAPGPVAEPPAPPFLFPPAPFLHGHFLGPAAEPIDPAAGGGGGPGDDFALAMAAPAGAPAAGFLMPLSVFN

SEQ ID NO: 2356 - DNA, 799 bp, Arabidopsis thaliana
  misc_feature (1)..(799): Ceres Clone ID no. 34761
  misc_feature (1)..(799): Encodes the peptide sequence at SEQ ID NO. 2357
acgatagcctctcatcttcttttttcctctccatcatcttcaccataaccgaaaaaccaaacaaaaaatccttagataatcagatcttgatattatggatcatatcatcggctttatgggcacaacaaacatgtcacataacacaaaccttatgatcgctgccgcagccactaccactacgacctcttcgtcttcctcttcttcctccggaggctcggggactaaccagctaagcaggtacgagaatcagaagagaagagattggaacactttcggacagtatctacgcaatcaccgtccaccactttctctctcccgttgcagtggtgctcatgttcttgaattcctcaggtacctcgaccaattcggcaagactaaggttcacacacacctatgtccgttcttcggacacccaaacccaccagcaccatgtgcctgtccactccgacaagcgtggggtagtctggacgcactcattggccgtcttagagctgcttttgaagagaacggtggttcaccagagacgaacccttttggtgcacgagccgttcgactctacctaagggaagtacgtgactcgcaggctaaagcacgtgggatcagctatgaaaaaaagaagcgcaagcgacctcctccgccactaccaccggctcagccggcgatttcaagtagccctaattaacattaagtcatgagtaagatgtttcaatgaactacgtttgtttacaaatttttatcaatgacgaacatgcacgagttcttttaaagtcacatgccctttcctaaacttttatttgac

SEQ ID NO: 2357 - protein, 195 aa, Arabidopsis thaliana
  misc_feature (30)..(162): Pfam Name: DUF640 Pfam Description: Protein of unknown function (DUF640)
  misc_feature (1)..(195): Ceres Clone ID no. 34761
  misc_feature (1)..(195): Bit score of 319.8 for HMM based on sequences of Figure 32
  misc_feature (1)..(195): Functional Homolog Of SEQ ID NO. 2271
MDHIIGFMGTTNMSHNTNLMIAAAATTTTTSSSSSSSSGGSGTNQLSRYENQKRRDWNTFGQYLRNHRPPLSLSRCSGAHVLEFLRYLDQFGKTKVHTHLCPFFGHPNPPAPCACPLRQAWGSLDALIGRLRAAFEENGGSPETNPFGARAVRLYLREVRDSQAKARGISYEKKKRKRPPPPLPPAQPAISSSPN

SEQ ID NO: 2358 - DNA, 897 bp, Brassica napus
  misc_feature (1)..(897): Ceres Clone ID no. 964932
  misc_feature (1)..(897): Encodes the peptide sequence at SEQ ID NO. 2359
acgataccccctcctctcctcctttttcctctccaccatcttcccttatcaactcaagacccataaagttcaagactcaagactcataaagctcctctcatattcatcataacctaaaaccaaaacctcaaagagttaataaaacctaaattatacatcagatcttgatatcatggatcctatccacggctttatgagcacatcaaacatctcacacaacacaaaccttatgatcgccgccgcagcagccaccactaccactacctcctcctcctcgtcttcctctggcggctccgcgacaaaccaactgagtaggtacgagaatcagaagagaagagactggaacactttcggacaatatctacgcaaccaccgtccaccactttctctctcccgttgcagtggtgctcatgttcttgagttcctcaggtacctcgaccaattcggcaagaccaaggttcacatgcaaatatgtcctttctttggacacccaaacccaccagcaccatgtacctgcccactcagacaagcgtggggcagcctcgacgcactcattggccggcttcgagctgcttttgaagagaacggtggttcaccagagacgaacccttttggtgcacgagctgttcgactctacctaagggaagttcgtgattcgcaggctaaagcgcgtgggatcagctatgaaaagaagaagcggaagcgacctcctcaggcgccactaccaccgcctcatcagccggtgatttcgaatagtcctaatttgcaataagtcatatcagtaagatatgtttcagtcaactacgtttccttacaactttatatagtatttgtcaatgacgaacatgcaggagttgtctaaaaagctgcatgcccttcttctttatttggccagct

SEQ ID NO: 2359 - protein, 199 aa, Brassica napus
  misc_feature (30)..(162): Pfam Name: DUF640 Pfam Description: Protein of unknown function (DUF640)
  misc_feature (1)..(199): Ceres Clone ID no. 964932
  misc_feature (1)..(199): Bit score of 321.1 for HMM based on sequences of Figure 32
  misc_feature (1)..(199): Functional Homolog Of SEQ ID NO. 2271
MDPIHGFMSTSNISHNTNLMIAAAAATTTTTSSSSSSSGGSATNQLSRYENQKRRDWNTFGQYLRNHRPPLSLSRCSGAHVLEFLRYLDQFGKTKVHMQICPFFGHPNPPAPCTCPLRQAWGSLDALIGRLRAAFEENGGSPETNPFGARAVRLYLREVRDSQAKARGISYEKKKRKRPPQAPLPPPHQPVISNSPNLQ

SEQ ID NO: 2360 - DNA, 1132 bp, Zea mays
  misc_feature (1)..(1132): Ceres Clone ID no. 1288341
  misc_feature (1)..(1132): Encodes the peptide sequence at SEQ ID NO. 2361
acgcctgcacatccccactcctaaaaatagtagccggcggcatgcaaatacgataccccacgccttcttcccgttcatgatatggagctctcctcagatcaataatgggcctatatatgagacgcacgagcaacgccagttagcaaccagccaccactaccaaccctccagtctcagtctccgtctcctgctgagcaacaaggcttcagcagttcagagattctgctggagcctggaggaagcttctctacccaccactccgacgcggccgccgtcgacgagatcagccgcgccgtcgccaccaaaggcaaaagaagagatcgagctcgaggctcgagctcgagcaggcagcagggagggggcacccagatatatagatccccaaaaggtgcatgtaatcatcggctgcgtcgtcacgtcagtcgttcatgtgtttgtatctgattcgtggatgccagattaattgatggacctgtccccgaaccccgagagcccgggaagcggtggtgatggcggcggtggcggaggcggagccgggggatcgagcagcggcggggcgtctccgtcggggggcttcggcacgccgcagacgccgagccggtacgaggcgcagaagcggcgggactggaacacgttcgggcagtacctgcggaaccaccggccgccgctgagcctggcgcagtgcagcggtgcgcacgtgctggagttcctgcgctacctggaccagttcggcaagaccaaggtgcacacgccggcgtgccccttcttcggccacccgaacccgcccgcgccgtgcccctgcccgctgcgccaggcctggggtagcctcgacgcgctggtgggccgcctccgcgccgccttcgaggagaacgggggccgcccggagtccaaccccttcgcggcgcgcgccgtccgcctctacctccgcgaggtccgcgagcaccaggcccgcgcgcgcggcgtcagctacgagaagaagaagcgcaagaaggcgcagcggccggctgatcatgccagcggcagtggaggcggccaaggacctcaccacccgccgcccgccggcgcgtcgggctgaggaacccatggtatgccggccggactgagcatattttatgtaggtttcgatcgattt

SEQ ID NO: 2361 - protein, 202 aa, Zea mays
  misc_feature (27)..(159): Pfam Name: DUF640 Pfam Description: Protein of unknown function (DUF640)
  misc_feature (1)..(202): Ceres Clone ID no. 1288341
  misc_feature (1)..(202): Bit score of 322.7 for HMM based on sequences of Figure 32
  misc_feature (1)..(202): Functional Homolog Of SEQ ID NO. 2271
MDLSPNPESPGSGGDGGGGGGGAGGSSSGGASPSGGFGTPQTPSRYEAQKRRDWNTFGQYLRNHRPPLSLAQCSGAHVLEFLRYLDQFGKTKVHTPACPFFGHPNPPAPCPCPLRQAWGSLDALVGRLRAAFEENGGRPESNPFAARAVRLYLREVREHQARARGVSYEKKKRKKAQRPADHASGSGGGQGPHHPPPAGASG

SEQ ID NO: 2362 - DNA, 1117 bp, Triticum aestivum
  misc_feature (1)..(1117): Ceres Clone ID no. 916104
  misc_feature (1)..(1117): Encodes the peptide sequence at SEQ ID NO. 2363
cttcaaggctattccagcacatgaagaaggtttcgtcttcgagcaacaagctctggccagctgcagcaagagcaactcaggtcagattaatggacctatgagcacagcaaccaccactactgctgctactgaggagcgatcaaattctcgagccagcttcttcacctcccgccgacgccactgctgctgctggtcgacctatcttcttcgcggctctgagtccgccaccggcgaaaaagggatcggccgcgcgccgccgtgattaaaggttgatccatggacctgtcgccaaaccccgagagcccgaatgccccgggcggcggtggcggcagcggcgccggtggatctagcggcggtggaggggcgtcctcgtctgctgggggtggaggcacaccgcagacgcccagccggtacgaggcgcagaagcggcgggactggaacacgttcgggcagtacctgcggaaccaccggccgccgctgagcctcgcgcagtgcagcggcgcgcacgtgctggagtttctgcggtacctggaccagttcggcaagaccaaggtgcacacggcgtcgtgccccttcttcggccacccaaacccgccggcgccctgcccctgcccgctgcgtcaggcgtgggggagcctcgacgcgctcgtgggacgccttcgcgccgcgttcgaggagcacggcggccgccccgagtccaaccccttcgccgcccgcgcggtccgcctgttcctccgcgaggtccgcgagcaccaggctcgcgcgcgcggcgtcagctacgagaagaagaagcgcaagaagccgacgcctggtgacgccagcagcagcagcagccaccaggctccacccccaccgccaccgccccccgccggtgcggcctgctgaggaggagagaggacctgtactgcgcacgtgcccatttggtatgccggaccgatgatgagcatattttatgtaggtctcgatcgattaactgcttgtgcatgcatgcattgttttactaccattctgccgggcttaagatctagactagatgattcagacttttattgatcgtgctacgtccatttgctagttattatttgcttctgcttaatttctactgccaagcttcctc

SEQ ID NO: 2363 - protein, 202 aa, Triticum aestivum
  misc_feature (27)..(159): Pfam Name: DUF640 Pfam Description: Protein of unknown function (DUF640)
  misc_feature (1)..(202): Ceres Clone ID no. 916104
  misc_feature (1)..(202): Bit score of 317.7 for HMM based on sequences of Figure 32
  misc_feature (1)..(202): Functional Homolog Of SEQ ID NO. 2271
MDLSPNPESPNAPGGGGGSGAGGSSGGGGASSSAGGGGTPQTPSRYEAQKRRDWNTFGQYLRNHRPPLSLAQCSGAHVLEFLRYLDQFGKTKVHTASCPFFGHPNPPAPCPCPLRQAWGSLDALVGRLRAAFEEHGGRPESNPFAARAVRLFLREVREHQARARGVSYEKKKRKKPTPGDASSSSSHQAPPPPPPPPAGAAC

SEQ ID NO: 2364 - DNA, 600 bp, Sorghum bicolor
  misc_feature (1)..(600): Ceres Annot ID no. 8701919
  misc_feature (1)..(600): Encodes the peptide sequence at SEQ ID NO. 2365
atggacatgtcgccgaaccccgacagcccctcgtcaggagggggcaacggcatcgggccgagcagcggtggcgcgtcgccgtccgttggctccatgacggcgccgcagtcgccgagccggtacgaggcgcagaagcggcgcgactggaacacgttcgggcagtacctgcggaaccaccggccgccactgagcctggcgcagtgcagcggggctcacgtcctcgagttcctccgctacctggaccagttcggcaagactaaggtgcacggcccggcgtgccccttcttcggccacccgaacccgccggcgccgtgcccctgcccgctccgccaggcctggggcagcctcgacgccctcgtgggccgcctccgcgccgccttcgaggagaacggaggccgcccggagtccaaccccttcgccgcgcgcgccgtgcgcctctacctccgcgaggtccgcgagcaccaggcccgcgcccggggcgtcagctacgagaagaagaagcgcaagaagccgcagcagctgccgggcgacagcagcggcggccttcacggccacacgcaccagccgccgccaccaccgcccgccggcgccgcctgctga

SEQ ID NO: 2365 - protein, 199 aa, Sorghum bicolor
  misc_feature (22)..(154): Pfam Name: DUF640 Pfam Description: Protein of unknown function (DUF640)
  misc_feature (1)..(199): Ceres Annot ID no. 8701919
  misc_feature (1)..(199): Bit score of 322.9 for HMM based on sequences of Figure 32
  misc_feature (1)..(199): Functional Homolog Of SEQ ID NO. 2271
MDMSPNPDSPSSGGGNGIGPSSGGASPSVGSMTAPQSPSRYEAQKRRDWNTFGQYLRNHRPPLSLAQCSGAHVLEFLRYLDQFGKTKVHGPACPFFGHPNPPAPCPCPLRQAWGSLDALVGRLRAAFEENGGRPESNPFAARAVRLYLREVREHQARARGVSYEKKKRKKPQQLPGDSSGGLHGHTHQPPPPPPAGAAC

SEQ ID NO: 2366 - DNA, 660 bp, Arabidopsis thaliana
  misc_feature (1)..(660): Ceres Annot ID no. 828846
  misc_feature (1)..(660): Encodes the peptide sequence at SEQ ID NO. 2367
atggatatgattccccaattgatggaaggctcttcagcttacggaggtgtcacaaacctcaacatcatctcaaacaactcctcctccgtcaccggagccaccggaggtgaagcaacgcaaccactgtcttcctcctcctcaccatcggcgaactcaagccgttacgagaaccagaagaggagagactggaacacgttcggacagtacttaaggaaccatcggccaccgctttcgctttcccgatgcagtggagctcacgtgctcgagttcctccgttacttggaccagttcggtaagacaaaagtccacacgaacatttgtcacttctatggccatcctaatcctccggcaccgtgtccgtgtcctctccgacaagcttggggaagtcttgacgctcttatcggtcgtcttcgagctgcctttgaggaaaacggaggcaagcctgagacgaatccttttggagctcgtgccgttaggctttatctaagggaagttagagatatgcagagtaaagctagaggtgttagctacgagaagaagaagcgaaagcgtcctcttccttcgtcgtcgacttcttcttcctccgccgtagctagccaccagcaatttcaaatgctaccgggtactagttctactactcaattaaagtttgagaagtaa

SEQ ID NO: 2367 - protein, 219 aa, Arabidopsis thaliana
  misc_feature (36)..(168): Pfam Name: DUF640 Pfam Description: Protein of unknown function (DUF640)
  misc_feature (1)..(219): Ceres Annot ID no. 828846
  misc_feature (1)..(219): Bit score of 336.2 for HMM based on sequences of Figure 32
  misc_feature (1)..(219): Functional Homolog Of SEQ ID NO. 2271
MDMIPQLMEGSSAYGGVTNLNIISNNSSSVTGATGGEATQPLSSSSSPSANSSRYENQKRRDWNTFGQYLRNHRPPLSLSRCSGAHVLEFLRYLDQFGKTKVHTNICHFYGHPNPPAPCPCPLRQAWGSLDALIGRLRAAFEENGGKPETNPFGARAVRLYLREVRDMQSKARGVSYEKKKRKRPLPSSSTSSSSAVASHQQFQMLPGTSSTTQLKFEK

SEQ ID NO: 2368 - protein, 226 aa, Picea sitchensis
  misc_feature (25)..(157): Pfam Name: DUF640 Pfam Description: Protein of unknown function (DUF640)
  misc_feature (1)..(226): Public GI ID no. 116780542
  misc_feature (1)..(226): Bit score of 359.1 for HMM based on sequences of Figure 32
  misc_feature (1)..(226): Functional Homolog Of SEQ ID NO. 2271
MSAEVVVGQGGSSATAAQLAPSSSSNGINEGSRELAASPAPSRYESQKRRDWNTFGQYLKNHRPPLALPRCSGAHVVEFLHYLDQFGKTKVHVPACPFFGHPHPPAPCACPLRQAWGSLDALIGRLRAAYEENGGKPESNPFGARAVRLYLREVRESQAKARGIAYEKRNASAPQFNSNNSSSNNMYSSTSTSTSTSTSTSSISSTSTSSKLRLTLCPTIPIQMSL

SEQ ID NO: 2369 - protein, 201 aa, Zea mays
  misc_feature (23)..(155): Pfam Name: DUF640 Pfam Description: Protein of unknown function (DUF640)
  misc_feature (1)..(201): Public GI ID no. 212723306
  misc_feature (1)..(201): Bit score of 312.8 for HMM based on sequences of Figure 32
  misc_feature (1)..(201): Functional Homolog Of SEQ ID NO. 2271
MDMPPNPDSPSSGGSNSIGRPSGGGASPSVGSTMPQSSPSRYEAQKRRDWNTFGQYLRNHRPPLSLAQCSGAHVLEFLRYLDQFGKTKVHGPACPFFGHPNPPAPCPCPLRQAWGSLDALVGRLRAAYEENGGRPESNPFAARAVRLYLCEVREHQARARGVSYEKKKRRKPQQLPGPGDSSGLHGHAHQPPPPPPAGAAC

SEQ ID NO: 2370 - DNA, 549 bp, Arabidopsis thaliana
  misc_feature (1)..(549): Ceres Annot ID no. 856813
  misc_feature (1)..(549): Encodes the peptide sequence at SEQ ID NO. 2371
atggagggagaaaccgcagccaaagcagcggcaagttcctcctcatccccgagccggtacgagtctcaaaagaggcgagactggaacactttccttcagtatctaaggaaccacaagccacctctgaatctgtctcgttgtagtggcgcacacgtccttgagttccttaagtacctcgaccagtttggtaagaccaaagtccatgccacggcttgtcccttcttcggacaacctaacccaccgtctcagtgcacttgccctctcaagcaagcttggggaagtctcgatgctctcatcggccgtctaagggctgctttcgaggaaatcggcggtggtcttcctgagtcaaaccctttcgctgccaaggctgttaggatctatcttaaagaagtccgtcaaacacaggctaaggctcgagggattccttacgacaagaagaaaagaaaacgtccgcatacagacacggcaactccaatcgccggtgacggagacgatgccgaaggaagtggtggtgctgctttggtcgttacggctgcaactacggtatag

SEQ ID NO: 2371 - protein, 182 aa, Arabidopsis thaliana
  misc_feature (1)..(134): Pfam Name: DUF640 Pfam Description: Protein of unknown function (DUF640)
  misc_feature (1)..(182): Ceres Annot ID no. 856813
  misc_feature (1)..(182): Bit score of 338.2 for HMM based on sequences of Figure 32
  misc_feature (1)..(182): Functional Homolog Of SEQ ID NO. 2271
MEGETAAKAAASSSSSPSRYESQKRRDWNTFLQYLRNHKPPLNLSRCSGAHVLEFLKYLDQFGKTKVHATACPFFGQPNPPSQCTCPLKQAWGSLDALIGRLRAAFEEIGGGLPESNPFAAKAVRIYLKEVRQTQAKARGIPYDKKKRKRPHTDTATPIAGDGDDAEGSGGAALVVTAATTV

SEQ ID NO: 2372 - DNA, 1160 bp, Panicum virgatum
  misc_feature (1)..(1160): Ceres Clone ID no. 2010260
  misc_feature (1)..(1160): Encodes the peptide sequence at SEQ ID NO. 2373
accttcaaacagatcatgaagctactgctctccctgcagctccccagtcaccagatgggcctatgagcaagccgtcagcagcgacagttacttaccaccaccgagaaagacttttcactgatcttgtgcagattcaagaagctagcctccacttctgacagcggcaagatcagccgccacctccaccaacggtgactgatctagccgatccatggacatgtcaccaaatcccgatagcccctcgtcaggagggggcaacggcggcggcggcgcatcgccgtccgttgtctcgatgacgccgcagtccccgagccgttacgaggcgcagaagcggcgcgactggaacacgtttggccagtacctgcggaaccaccgcccgccgctgagtctggctcagtgcagcggcgcgcacgtcctcgagttcctgcgctacctggaccagttcggcaagaccaaggtgcacgcggcggcgtgccccttcttcggccaccccaacccgccggcgccctgcccctgcccgctccggcaggcctggggcagcctcgacgcccttgtcggccgcctgcgcgccgccttcgaggagaacggaggccgcccagagtccaacccctttgccgcgcgtgctgtccgcctctacctccgcgaggtccgcgagcaccaggcccgtgcgcgtggcgtcagctacgagaagaagaagcgcaagaagccacagcagctgcagggcgagggcagcggccttcaaggccaccaccatcaccagcctccgccgccgccgcccgccgcagcctgctgaacaccgaccgatcattctgcctacgctctcctgtttggccggtatgccagattgagcttgagcacatatattttatgtatcatctgcttctgcatgcatgcatgtgcatggcagtggcttcgtgctgctgattcgtgtactcttttatcgtgacaaagtactagtgtagtcggtgctcgtgcgtgcctactgcattgcttgtgtgtttccattggatttagctttgtgtcgtcgaatctattagctgcttgtacgagtgaggaagtgtttgctgtactttgaaccgaggagtgtgtcctctgaggtctagagatccagctagagacagggagatacatatatggagatctctcgtgctgctttgtgg

SEQ ID NO: 2373 - protein, 193 aa, Panicum virgatum
  misc_feature (17)..(149): Pfam Name: DUF640 Pfam Description: Protein of unknown function (DUF640)
  misc_feature (1)..(193): Ceres Clone ID no. 2010260
  misc_feature (1)..(193): Bit score of 323.9 for HMM based on sequences of Figure 32
  misc_feature (1)..(193): Functional Homolog Of SEQ ID NO. 2271
MDMSPNPDSPSSGGGNGGGGASPSVVSMTPQSPSRYEAQKRRDWNTFGQYLRNHRPPLSLAQCSGAHVLEFLRYLDQFGKTKVHAAACPFFGHPNPPAPCPCPLRQAWGSLDALVGRLRAAFEENGGRPESNPFAARAVRLYLREVREHQARARGVSYEKKKRKKPQQLQGEGSGLQGHHHHQPPPPPPAAAC

SEQ ID NO: 2374 - DNA, 1558 bp, Glycine max
  misc_feature (1)..(1558): Ceres Clone ID no. 662956
  misc_feature (1)..(1558): Encodes the peptide sequence at SEQ ID NO. 2375
accctttctctcagttccggtacgacattacataactctcagtttctcgcgcttttctggaaacaaatacctgatgtccctgatcccatcctttaccctttaccctttacccaggaatcattccatttcccaccaattaccactctcacactccgagccaacattaaccaaaccttattcccttcctttcctctctctctctctctcttgaaaaataatggaaaccactcaccattctagctttcatctgtcactgcccaggttgctgctgtcttctcggtcttccctttccagccacaccctagtcatcatctcaggcaatctttctttctctgcatgatattaatattatattcttttttctaataaatatcactactacacatcaatatcaatattcatcaatattattatgaaaagaaaaccctagtccttggaagaacgagaagaagttttcgttagcaaagctatccaagtagcatcatattagtctcaggctctgcaagatctaaagcagatccaagggtttaaagaaaagcatatcagatccatggatttagtttctgaatcaaaaaacgtcgtttcaaacgttacaaaccccagcagcaggtacaagatggagacagtacccaccccgaccaccacgaatcatccaacgacggcggcggcagtgtcgtcgccgtcttcgggaagcaacaacagcgggagcactactactccgagccgctacgagaaccaaaagcgaagggactggaacacgttctgccagtacctgaggaaccaccgtccgccactctccttggccttgtgcagcggtgcgcacgtgctggaattcctccactacctcgaccagttcgggaagactaaggttcataaccacccttgcccgttcttcggtctccccaacccacctgccccatgtccctgcccgctccgccaagcctggggcagcctcgacgccctcatcggccgcctccgcgccgcctacgaggagaacggcggccgcccggagaccaaccccttcggcgcacgcgccgtcaggatttaccttcgcgatgttcgcgattttcaggcaaaggcgagaggtgttagctacgagaagaagaggaagaggccaaagcctaaggtcactcccactcctacttaattgagaagcttgttgctaccaatgtttcaccacaggtatcaaatatgaatcgtatattattatatggtgtgtgtgtgtttttatttatttggttttgtgttttgtcctttgtatgttgatcctttatgatgggtttagtaaaccaagtcgtcgatgttttgtgctgctttctttttttttttgcaattttaaggtgcttttgttgtctctacgaagacgtgttgagatgatgatgccctttaaattgttctcgcttctggagtccggggaagtagatagtggtaattaagtgccaccaccctgccgccaactactactctagaagatatcttatcatatttgtactcaaattaatatataatatatcatgttcatcatctagtgtatttatgaagcatgcacttgaatctt

SEQ ID NO: 2375 - protein, 198 aa, Glycine max
  misc_feature (41)..(173): Pfam Name: DUF640 Pfam Description: Protein of unknown function (DUF640)
  misc_feature (1)..(198): Ceres Clone ID no. 662956
  misc_feature (1)..(198): Bit score of 308.2 for HMM based on sequences of Figure 32
  misc_feature (1)..(198): Functional Homolog Of SEQ ID NO. 2271
MDLVSESKNVVSNVTNPSSRYKMETVPTPTTTNHPTTAAAVSSPSSGSNNSGSTTTPSRYENQKRRDWNTFCQYLRNHRPPLSLALCSGAHVLEFLHYLDQFGKTKVHNHPCPFFGLPNPPAPCPCPLRQAWGSLDALIGRLRAAYEENGGRPETNPFGARAVRIYLRDVRDFQAKARGVSYEKKRKRPKPKVTPTPT

SEQ ID NO: 2376 - DNA, 612 bp, Populus balsamifera subsp. trichocarpa
  misc_feature (1)..(612): Ceres Annot ID no. 1459517
  misc_feature (1)..(612): Encodes the peptide sequence at SEQ ID NO. 2377
atggactctgttcaagatttcaacagtgccgcaacaaacccaataatcacactccccctcgccaccaccaacacggcctccccctcctcttcctcctccatcaccaccaccacctcccccaccactctcagccgctatgagaaccagaagcggcgagactggaacacctttgggcaatacctccggaaccaccgtcccccgctctcactctcccggtgcagtggagcccacgtcctcgagttcttgcgttaccttgatcagtttggaaaaaccaaagtccacacccaactctgccccttctttggccacccgaacccgcctgcaccgtgcccatgcccgctccgccaggcctggggaagcctcgatgcactcattggccgtctccgtgctgcctttgaagagcacggaggcaagcctgagaacaacccttttggggctcgtgctgttaggctttatctacgtgaagttagggactcgcagtctaaagctagagggattagctacgagaagaagaagagaaagagaccaccacagcagcagaatcctgcttcactgatgccaccacaagcaccaccagagagtactactagtgcaagtgagaattatcagtaa

SEQ ID NO: 2377 - protein, 203 aa, Populus balsamifera subsp. trichocarpa
  misc_feature (27)..(159): Pfam Name: DUF640 Pfam Description: Protein of unknown function (DUF640)
  misc_feature (1)..(203): Ceres Annot ID no. 1459517
  misc_feature (1)..(203): Bit score of 334.4 for HMM based on sequences of Figure 32
  misc_feature (1)..(203): Functional Homolog Of SEQ ID NO. 2271
MDSVQDFNSAATNPIITLPLATTNTASPSSSSSITTTTSPTTLSRYENQKRRDWNTFGQYLRNHRPPLSLSRCSGAHVLEFLRYLDQFGKTKVHTQLCPFFGHPNPPAPCPCPLRQAWGSLDALIGRLRAAFEEHGGKPENNPFGARAVRLYLREVRDSQSKARGISYEKKKRKRPPQQQNPASLMPPQAPPESTTSASENYQ

SEQ ID NO: 2378 - DNA, 974 bp, Panicum virgatum
  misc_feature (1)..(974): Ceres Clone ID no. 1994588
  misc_feature (1)..(974): Encodes the peptide sequence at SEQ ID NO. 2379
atgagacgacgagcaacggcagtcagcaacaaccgaagaccaccactgccactccagattctcgagtcagcttcagctccagctagagacctgctggagtctcctccaaccgctccgacgggccctccgccgagatcagccggcatcgccacgaaagattgatggacctgtcgccgaaccccgagagcccgggcggcggcggcggtgatggcggcggcggagccggtggatcgagcagcggcgggggggcgtcctcgtcggcgggcggcggcggcggcggcgcgccgcagacgccgagccggtacgaggcgcagaagcggcgggactggaacacgttcgggcagtacctgcggaaccaccggccgccgctgagcctggcgcagtgcagcggcgcccacgtcctcgagttcctgcggtacctggaccagttcggcaagaccaaggtgcacacggcggcgtgccccttcttcgggaacccgaacccgccggcgccgtgcccctgcccgctgcgccaggcgtggggcagcctggacgcgctggtgggccgcctcagagccgccttcgaggagaagggcggccggccggagtccaaccccttcgcggcgcgcgccgtccgcctctacctccgcgaggtccgcgagcaccaggcccgcgcgcgcggcgtcagctacgagaagaagaagcgcaagaagccgcagccgccggccgatcacgccggcggcagcggacacccgccgcctccggcgccgccgcccgccggcgcgccgtgctgaggaacgacatgcacccgccaccagcgcccatttggtatgccggactgagcatattttatgtaggtttcgatcgatttccgtgtgcatgcatgcatggtttgctgccattatttcgctcgcgatgcttcagcttcttcttcctcgatcagactctgccgatcgtgtgccgggctacattgttatttcactcctgctctctct

SEQ ID NO: 2379 - protein, 203 aa, Panicum virgatum
  misc_feature (29)..(161): Pfam Name: DUF640 Pfam Description: Protein of unknown function (DUF640)
  misc_feature (1)..(203): Ceres Clone ID no. 1994588
  misc_feature (1)..(203): Bit score of 314.4 for HMM based on sequences of Figure 32
  misc_feature (1)..(203): Functional Homolog Of SEQ ID NO. 2271
MDLSPNPESPGGGGGDGGGGAGGSSSGGGASSSAGGGGGGAPQTPSRYEAQKRRDWNTFGQYLRNHRPPLSLAQCSGAHVLEFLRYLDQFGKTKVHTAACPFFGNPNPPAPCPCPLRQAWGSLDALVGRLRAAFEEKGGRPESNPFAARAVRLYLREVREHQARARGVSYEKKKRKKPQPPADHAGGSGHPPPPAPPPAGAPC

SEQ ID NO: 2380 - DNA, 1766 bp, Glycine max
  misc_feature (1)..(1766): Ceres Clone ID no. 571893
  misc_feature (1)..(1766): Encodes the peptide sequence at SEQ ID NO. 2381
attttttctcttcttttcttttctcccttgcacaccttccatgccttctattaattctctagagatcttcttccttctccttaacctcacaactcttgaaaatcctccttatcgatccaacaagcagcaaactcactgaacaaatccacaaacagaaacaaagatcctactcgtgtagatctaataacatcaccttcttcttctcctacagatcatgaattcctttcaagaatttgactcatcaaacacaaacagtaccaaagccaccaatttcccatcatcatcatcagcagcaccagcagcaacagcaccaccatgttcttcttcttcttcttcgaccactctgagccgctacgagaaccaaaagcggcgcgactggaacacgttcgggcagtacctccgcaaccacaggcccccactctcgctctcacggtgcagcggcgcgcacgtgctggagttcctgcggtacctcgaccagttcgggaaaaccaaggttcacacgcagctttgtcccttcttcgggcacccgaaccctccagcaccgtgcccttgtcctctacgccaagcatgggggagcctcgacgcactcatagggcgcctcagagctgcttttgaagagaatggaggaaaacctgaagctaacccttttggcgctcgcgctgtgagactctaccttcgtgaagtgcgtgattcgcaagccaaggctaggggtattagctacgagaaaaagaagcgcaagcgtccccaacaaccttcattgcctccctctaataatgcaaaagttgtgatttgacaataggctgggggcatgtggacaccctttgcaattgcattagaaaaatattgtgtaaacctaaacagcagtactacttttggtagatgcagcagtaatttaagtagtggcagtaaaaaacactgtggagggctgtgctgctggtgctgctgatgatgatgatgggaaattggtggctttggtactgtttgtgkttgatgagtcaaattcttgaaaggaattcatgatctgtaggagaagaagaaggtgatgttattagatctacacgagtaggatctttgtttctggcgagggatctggtgttattgttgagggatccctggttgcggagcctgttgcaactcccccagctgctgacactaaggctgctgttgctgaggatgacgatgatgatgatgttgatttgtttggtgaagagactgaggaagagaagaaggcagctgaggaacgggcagctgcagtgaaggcatctgcaaaaaagaaagagtctgggaaatcatctgttctgttggatgtaaaaccatgggatgatgaaactgacatgaagaagcttgaagaatcagtgagatctgttcagatggaagggttgctttggggtgcatccaaacttgttcctgttggatacggtattaagaaactgcaaattatgcttactattgtggatgacctagtttctgttgatactcttattgaggaacatctcacagttgagcccatcaatgaatatgtccagagttgtgacattgtggccttcaataaaatataaactacaatcggtgggatttggagatcatggcaactgggagaattgcaagttttagaaactatgttctagggggaactaccctgaattgagaatttttgtctttagaaacccgcttatattatttgtttctatatatctttgttttgtcatcggattatttggatagtaataatttcacctttaatgtgtcaacggattatttggatg

SEQ ID NO: 2381 - protein, 192 aa, Glycine max
  misc_feature (28)..(160): Pfam Name: DUF640 Pfam Description: Protein of unknown function (DUF640)
  misc_feature (1)..(192): Ceres Clone ID no. 571893
  misc_feature (1)..(192): Bit score of 318.9 for HMM based on sequences of Figure 32
  misc_feature (1)..(192): Functional Homolog Of SEQ ID NO. 2271
MNSFQEFDSSNTNSTKATNFPSSSSAAPAATAPPCSSSSSSTTLSRYENQKRRDWNTFGQYLRNHRPPLSLSRCSGAHVLEFLRYLDQFGKTKVHTQLCPFFGHPNPPAPCPCPLRQAWGSLDALIGRLRAAFEENGGKPEANPFGARAVRLYLREVRDSQAKARGISYEKKKRKRPQQPSLPPSNNAKVVI

SEQ ID NO: 2382 - DNA, 1558 bp, Glycine max
  misc_feature (1)..(1558): Ceres Clone ID no. 572195
  misc_feature (1)..(1558): Encodes the peptide sequence at SEQ ID NO. 2383
accctttctctcagttccggtacgacattacataactctcagtttctcgcgcttttctggaaacaaatacctgatgtccctgatcccatcctttaccctttaccctttacccaggaatcattccatttcccaccaattaccactctcacactccgagccaacattaaccaaaccttattcccttcctttcctctctctctctctctcttgaaaaataatggaaaccactcaccattctagctttcatctgtcactgcccaggttgctgctgtcttctcggtcttccctttccagccacaccctagtcatcatctcaggcaatctttctttctctgcatgatattaatattatattcttttttctaataaatatcactactacacatcaatatcaatattcatcaatattattatgaaaagaaaaccctagtccttggaagaacgagaagaagttttcgttagcaaagctatccaagtagcatcatattagtctcaggctctgcaagatctaaagcagatccaagggtttaaagaaaagcatatcagatccatggatttagtttctgaatcaaaaaacgtcgtttcaaacgttacaaaccccagcagcaggtacaagatggagacagtacccaccccgaccaccacgaatcatccaacgacggcggcggcagtgtcgtcgccgtcttcgggaagcaacaacagcgggagcactactactccgagccgctacgagaaccaaaagcgaagggactggaacacgttctgccagtacctgaggaaccaccgtccgccactctccttggccttgtgcagcagtgcgcacgtgctggaattcctccactacctcgaccagttcgggaagactaaggttcataaccacccttgcccgttcttcggtctccccaacccacctgccccatgtccctgcccgctccgccaagcctggggcagcctcgacgccctcatcggccgcctccgcgccgcctacgaggagaacggcggccgcccggagaccaaccccttcggcgcacgcgccgtcaggatttaccttcgcgatgttcgcgattttcaggcaaaggcgagaggtgttagctacgagaagaagaggaagaggccaaagcctaaggtcactcccactcctacttaattgagaagcttgttgctaccaatgtttcaccacaggtatcaaatatgaatcgtatattattatatggtgtgtgtgtgtttttatttatttggttttgtgttttgtcctttgtatgttgatcctttatgatgggtttagtaaaccaagtcgtcgatgttttgtgctgctttctttttttttttgcaattttaaggtgcttttgttgtctctacgaagacgtgttgagatgatgatgccctttaaattgttctcgcttctggagtccggggaagtagatagtggtaattaagtgccaccaccctgccgccaactactactctagaagatatcttatcatatttgtactcaaattaatatataatatatcatgttcatcatctagtgtatttatgaagcatgcacttgaatctt

SEQ ID NO: 2383 - protein, 198 aa, Glycine max
  misc_feature (41)..(173): Pfam Name: DUF640 Pfam Description: Protein of unknown function (DUF640)
  misc_feature (1)..(198): Ceres Clone ID no. 572195
  misc_feature (1)..(198): Bit score of 304.0 for HMM based on sequences of Figure 32
  misc_feature (1)..(198): Functional Homolog Of SEQ ID NO. 2271
MDLVSESKNVVSNVTNPSSRYKMETVPTPTTTNHPTTAAAVSSPSSGSNNSGSTTTPSRYENQKRRDWNTFCQYLRNHRPPLSLALCSSAHVLEFLHYLDQFGKTKVHNHPCPFFGLPNPPAPCPCPLRQAWGSLDALIGRLRAAYEENGGRPETNPFGARAVRIYLRDVRDFQAKARGVSYEKKRKRPKPKVTPTPT

SEQ ID NO: 2384 - DNA, 676 bp, Panicum virgatum
  misc_feature (1)..(676): Ceres Clone ID no. 1990206
  misc_feature (1)..(676): Encodes the peptide sequence at SEQ ID NO. 2385
accccacctctccccaagctcgctcacctcagctgctggcctcctcctctcccgtccctttccaccgatcgagcttcttctaactgctggtgcagatctgggttggccttcgtggacaggcggcggcgaaggagctatggagatggccggcgcggcggacagcccgggcctggcggcggcgcggccgagccggtacgagtcgcagaagcgccgggactggcagacgttcgggcagtacctgcgcaaccaccggccgccgctggagctggcccggtgcagcggcgcgcacgtgctcgagttcctccgctacctggaccagttcggcaagaccaaggttcacgcgccggggtgccccttcttcggccacccgtcgccgccggcgccgtgcccgtgcccgctcaagcaggcgtggggcagcctcgacgcgctcgtcggccgcctccgcgccgccttcgaggagcacggcggccgccccgaggccaaccccttcggggcgcgcgccgtccggctctacctccgcgaggtccgcgacacccaggccaaggcgcgcggcatcgcctacgagaagaaacgccgcaagcgccacccgccggcacacaggcaggccaagcagcagcaggacgccggccagcagcagcagcagcactaccacccccaccaccaccacaccaggcgt

SEQ ID NO: 2385 - protein, 180 aa, Panicum virgatum
  misc_feature (1)..(133): Pfam Name: DUF640 Pfam Description: Protein of unknown function (DUF640)
  misc_feature (1)..(180): Ceres Clone ID no. 1990206
  misc_feature (1)..(180): Bit score of 307.2 for HMM based on sequences of Figure 32
  misc_feature (1)..(180): Functional Homolog Of SEQ ID NO. 2271
MEMAGAADSPGLAAARPSRYESQKRRDWQTFGQYLRNHRPPLELARCSGAHVLEFLRYLDQFGKTKVHAPGCPFFGHPSPPAPCPCPLKQAWGSLDALVGRLRAAFEEHGGRPEANPFGARAVRLYLREVRDTQAKARGIAYEKKRRKRHPPAHRQAKQQQDAGQQQQQHYHPHHHHTRR

SEQ ID NO: 2386 - protein, 191 aa, Oryza sativa subsp. japonica
  misc_feature (5)..(137): Pfam Name: DUF640 Pfam Description: Protein of unknown function (DUF640)
  misc_feature (1)..(191): Public GI ID no. 115444445
  misc_feature (1)..(191): Bit score of 323.3 for HMM based on sequences of Figure 32
  misc_feature (1)..(191): Functional Homolog Of SEQ ID NO. 2271
MDMIGMASPAESPGGGGTARPSRYESQKRRDWQTFGQYLRNHRPPLELSRCSGAHVLEFLRYLDQFGKTKVHAHGCPFFGHPSPPAPCPCPLRQAWGSLDALVGRLRAAFEEHGGRPESNPFGARAVRLYLRDIRDTQSKARGIAYEKKRRKRAAASHTKQKQQQQQLVEQAAAAAEAHAAGCMMPLSVFN

SEQ ID NO: 2387 - DNA, 599 bp, Triticum aestivum
  misc_feature (1)..(599): Ceres Clone ID no. 1461999
  misc_feature (1)..(599): Encodes the peptide sequence at SEQ ID NO. 2388
cctccctctcctcctcccctcgccaccacacccaatcgcccgctcgctcccccggctcggcaacgatcgatctctccttctccccgagctgctccgtcgtccggacggcgccgtcgaccgcgcgcttgccagatctgaagtcaaaggaggacaggacggacatgcagggagcgccggtggacagcccgggggcggcggaggcagcggcgcggccgagccggtacgagtcgcagaagcgccgggactggcacactttcgggcagtaccttcgcaaccaccgcccgccgctggagctctcgcggtgcagcggcgcccacgtcctcgagttcctccgctacctcgaccagttcggcaagaccaaggtccacgctccaggctgccccttcttcggccacccttccccgccggcgccctgcccgtgcccgctccgccaggcctggggcagcctggacgcgctcgtcggccgcctgcgcgccgccttcgaggagcacggcgggcggcccgaggccaacccgttcggcgcgcgcgccgtccgcctctacctccgcgaggtgcgcgactcccaggccaaggcacgcggcatcgcctacgagaagaag

SEQ ID NO: 2388 - protein, 199 aa, Triticum aestivum
  misc_feature (55)..(187): Pfam Name: DUF640 Pfam Description: Protein of unknown function (DUF640)
  misc_feature (1)..(199): Ceres Clone ID no. 1461999
  misc_feature (1)..(199): Bit score of 273.1 for HMM based on sequences of Figure 32
  misc_feature (1)..(199): Functional Homolog Of SEQ ID NO. 2271
SLSSSPRHHTQSPARSPGSATIDLSFSPSCSVVRTAPSTARLPDLKSKEDRTDMQGAPVDSPGAAEAAARPSRYESQKRRDWHTFGQYLRNHRPPLELSRCSGAHVLEFLRYLDQFGKTKVHAPGCPFFGHPSPPAPCPCPLRQAWGSLDALVGRLRAAFEEHGGRPEANPFGARAVRLYLREVRDSQAKARGIAYEKK

SEQ ID NO: 2389 - DNA, 1641 bp, Gossypium hirsutum
  misc_feature (1)..(1641): Ceres Clone ID no. 1884986
  misc_feature (1)..(1641): Encodes the peptide sequence at SEQ ID NO. 2390
acgaccctcaaaaatcttctactcatatatttcagcaactcaatctgagaaaagacgaccctcaaaaatcttctagtattgctccaagcaaagaaaaactcaagagagggggggatcatttctctctcttttcccatcaatctcatcagatcatccacactttctctcatatctaacaactacaaatcattaaaactactatttcaactccaaaatcttcttctgtttagctgcctagctctcctcacaaatggaaattgtgtctaatataaatcaatagtcggcaaggtcttccactcttccttcctggttaaagcaaagcacttctgtttttttttttttttttactttgggttttcttcttgacggtgttgtttcatatcaacagttctatctgccagagaaaagagtagagactaaattatgtatgtaaaactaagtttttttttggttccttgattcattttttacagtttcttcgtctttaatctctccttttcttgttaggtctatgttacactgtcttatggtcactgaaaaagtgttttttataaaggaaagatgaaaccctaggtacttaagatcttaagaaataagatcaaacctaccacagcgaagaccaacacatctttttgcttatatatttggaacaagacctattgaaagctgtgtttggtctccatggattcaattcgagaaaccgatagctccaactccgaaaatgtcagcctcatcaatgtgagcaataacggtggcacttcacttccatcctcgtcttcttctccaaccgcaagccgctacgagaaccaaaagcgccgtgactggaacacctttggtcagtaccttaagaatcataggcccccactttccctctccaggtgcagtggagctcacgtcctagaattccttcgctaccttgaccaattgggcaaaaccaaagtccacactccaatctgccctttctatggccacccaaacccaccagccccttgcccttgcccgctccgtcaagcctggggtagcctcgatgctctcatcggccgcctccgagctgccttcgaagaaaatggaggaaaacctgaagtaaacccttttggggcacgagctgtgaggctttaccttcgtgaagttcgtgatttgcagtcaaaagcaagagggattagttatgagaagaagaagcgtaagcgaccaccaactcaacagatcccgactctaccaatgccgccgccaccaccaccaggtgcaagttaaactataaaaagaagcgtaagcgaccaccagctcaacagatcccgactctaccattgccgccaccaccaccaccaggtgcaagttaaactatatatatgcatcaccaaaacaaaacaaaacaaaaccccatatgcaagctagcatttcactctatttaatactacatatatgggataattttctgtactttggccataaggtatcatattgaggcatgggtatatattttagggaaaatttttttttttttactttttctatgcttcctctttgctgctagagtggtaaaaactggtaatgtctttgtgatttttggggattccttgaaactacttttgatgcaaacagtgttagtatcatcagtaatgaactattagtagcactagtact

SEQ ID NO: 2390 - protein, 189 aa, Gossypium hirsutum
  misc_feature (21)..(153): Pfam Name: DUF640 Pfam Description: Protein of unknown function (DUF640)
  misc_feature (1)..(189): Ceres Clone ID no. 1884986
  misc_feature (1)..(189): Bit score of 307.0 for HMM based on sequences of Figure 32
  misc_feature (1)..(189): Functional Homolog Of SEQ ID NO. 2271
MDSIRETDSSNSENVSLINVSNNGGTSLPSSSSSPTASRYENQKRRDWNTFGQYLKNHRPPLSLSRCSGAHVLEFLRYLDQLGKTKVHTPICPFYGHPNPPAPCPCPLRQAWGSLDALIGRLRAAFEENGGKPEVNPFGARAVRLYLREVRDLQSKARGISYEKKKRKRPPTQQIPTLPMPPPPPPGAS

SEQ ID NO: 2391 - protein, 275 aa, Oryza sativa subsp. japonica
  misc_feature (1)..(132): Pfam Name: DUF640 Pfam Description: Protein of unknown function (DUF640)
  misc_feature (1)..(275): Public GI ID no. 125580940
  misc_feature (1)..(275): Bit score of 295.0 for HMM based on sequences of Figure 32
  misc_feature (1)..(275): Functional Homolog Of SEQ ID NO. 2271
MASPAESPGGGGTARPSRYESQKRRDWQTFGQYLRNHRPPLELSRCSGAHVLEFLRYLDQFGKTKVHAHGCPFFGHPSPPAPCPCPLRQAWGSLDALVGRFRAAFEEHGGRPESNPFGARAVRLYLGDIRDTQSKARGIAYEKKRRQGGRGFQHQAEAAAAAAGGTGGGAARRRRRRRGAAGHGDDDDDDHGAALLVPGALPPRPLLPGTGRRAARRRRRRGVDGRRCRCSQRRRRGGPGAGHGGGGGGRRGARRRLHDATVGVQLAPPSISINP

SEQ ID NO: 2392 - DNA, 987 bp, Glycine max
  misc_feature (1)..(987): Ceres Clone ID no. 625781
  misc_feature (1)..(987): Encodes the peptide sequence at SEQ ID NO. 2393
acatcttgtactaaacacacacatttctagtccccaaaccctaaactagaagagaaaaagagaaagtgcaacatcataacatcaaattcgtatgtgcttttgcttaccctaaaatctccatccctacaaaaagaagaagaaaaacaagaagaagtttaacatgtcagctgccgtggccgcttccgctgccgccgctaccatgtcgggttaccaccacaactcctcctcgagacaacaacaacacatagaccatgaattggccttaacaccacaacgagtgtgtgtctctccacctctgagcaggtacgagtcacagaagcggcgcgattggaacaccttcgggcaatacctgaaaaaccaccgaccacctttgactctctcacgctgcagcggcgcgcacgttctggaattcctccgctacctcgaccagttcggaaaaaccaaggttcacgccgaaacctgcggatactttggaaactcccaccctccgggtccctgcgcgtgtcccctgaggcaggcgtggggcagcctcgacgcgctcattggccggctacgcgccgccttcgaggagaacggcggcgcgccggagatgaacccgttcgggacacgcgcagtgaggttgtacctcagggaagtgagggacgcgcaggccaaggcgagaggcatagcttatgagaagaagaaacggagaaaaccacaacaaagtggacatgatcatgatcatgatgcgatgatgatggtgggttctacgagtgatgtgaattattcttcagggtatagtggtggtggtggtggtgcctttgttcctcatcagcaaatgttgtctgattcgaatgggacagcttctacatctgatggggtttcttatttctcatcatcatcccagtgtggtgggtttaattgattgcgatcatgcgtgttatttgatccctaagaatcaaaaatagtgtcaaaaatttacaataagtggcacatccttcttcaacc

SEQ ID NO: 2393 - protein, 247 aa, Glycine max
  misc_feature (32)..(162): Pfam Name: DUF640 Pfam Description: Protein of unknown function (DUF640)
  misc_feature (1)..(247): Ceres Clone ID no. 625781
  misc_feature (1)..(247): Bit score of 345.8 for HMM based on sequences of Figure 32
  misc_feature (1)..(247): Functional Homolog Of SEQ ID NO. 2271
MSAAVAASAAAATMSGYHHNSSSRQQQHIDHELALTPQRVCVSPPLSRYESQKRRDWNTFGQYLKNHRPPLTLSRCSGAHVLEFLRYLDQFGKTKVHAETCGYFGNSHPPGPCACPLRQAWGSLDALIGRLRAAFEENGGAPEMNPFGTRAVRLYLREVRDAQAKARGIAYEKKKRRKPQQSGHDHDHDAMMMVGSTSDVNYSSGYSGGGGGAFVPHQQMLSDSNGTASTSDGVSYFSSSSQCGGFN

SEQ ID NO: 2394 - DNA, 546 bp, Solanum lycopersicum
  misc_feature (1)..(546): Ceres Annot ID no. 8454580
  misc_feature (1)..(546): Encodes the peptide sequence at SEQ ID NO. 2395
atgttagacgtatatagtaccattaattccgtctcacaaaacttctccctatcatcggcgccggcgccgacactaccactaccgccgccttcgtcaccaccgacggtgagccgttacgagctacaaaaacggcgagactggaacacattcggacagtacttgagaaaccacaagccaccactgatacttgcgcgatgcagcggagcgaacattctagaattcttaaaatacctagatcaattcggaaaaacgaaagttcacagctgtaattgtccgtttttcggcgatcctcatccgccggcgccgtgcaattgcccgttgaaacaggcgtgggggagccttgacgcgctaattgggaggctacgcgctgctttcgaagagaacggaggacggacggagacgaatccgttcggtgctcgagcagtgaggttgtatttgaaggaagtgagagacacgcaagccaaagcgagggggattgcttatgagaagaagaaaagaagaaatattaagcagcggattagtagtactattaataattgtgattag

SEQ ID NO: 2395 - protein, 181 aa, Solanum lycopersicum
  misc_feature (20)..(152): Pfam Name: DUF640 Pfam Description: Protein of unknown function (DUF640)
  misc_feature (1)..(181): Ceres Annot ID no. 8454580
  misc_feature (1)..(181): Bit score of 286.0 for HMM based on sequences of Figure 32
  misc_feature (1)..(181): Functional Homolog Of SEQ ID NO. 2271
MLDVYSTINSVSQNFSLSSAPAPTLPLPPPSSPPTVSRYELQKRRDWNTFGQYLRNHKPPLILARCSGANILEFLKYLDQFGKTKVHSCNCPFFGDPHPPAPCNCPLKQAWGSLDALIGRLRAAFEENGGRTETNPFGARAVRLYLKEVRDTQAKARGIAYEKKKRRNIKQRISSTINNCD

SEQ ID NO: 2396 - DNA, 568 bp, Brassica napus
  misc_feature (1)..(568): Ceres Clone ID no. 1457623
  misc_feature (1)..(568): Encodes the peptide sequence at SEQ ID NO. 2397
aaagaaaaacaaaaaaaaccctagttttgatggaatcgactgattcggggtcacaacaacatggaggtgatccgggtccgtcttccgtaacgccctcttcacctccggcgacgccccctagcaggtacgagtcgcagaaacgacgtgactggaacacgttcttgcagtacctcaagaaccacaagccgcctctcgcgttatcacgttgtagcggagcgcacgtgatcgagttcctcaagtacctagatcagttcggtaagaccaaagtccacgtggcgacctgtccttacttcggacatcagcagcctccctctccttgcgcttgtcctctcaagcaagcctggggatctctcgatgctctgatcggacggttgagagctgcgtacgaggagcacggtgggaggcctgattccaacccgttcgccgcacgtgcggtcaggatttacttgagagaagtcagggaaagcaagccaaggcacgtgggattccatacgagaagaagaaacggaaacgggcaccaactgttaccaccgctagaattgacgttgctccgtccagacaaagtgaa

SEQ ID NO: 2397 - protein, 179 aa, Brassica napus
  misc_feature (14)..(146): Pfam Name: DUF640 Pfam Description: Protein of unknown function (DUF640)
  misc_feature (1)..(179): Ceres Clone ID no. 1457623
  misc_feature (1)..(179): Bit score of 313.9 for HMM based on sequences of Figure 32
  misc_feature (1)..(179): Functional Homolog Of SEQ ID NO. 2271
MESTDSGSQQHGGDPGPSSVTPSSPPATPPSRYESQKRRDWNTFLQYLKNHKPPLALSRCSGAHVIEFLKYLDQFGKTKVHVATCPYFGHQQPPSPCACPLKQAWGSLDALIGRLRAAYEEHGGRPDSNPFAARAVRIYLREVRESKPRHVGFHTRRRNGNGHQLLPPLELTLLRPDKV

SEQ ID NO: 2398 - DNA, 573 bp, Arabidopsis thaliana
  misc_feature (1)..(573): Ceres Annot ID no. 853637
  misc_feature (1)..(573): Encodes the peptide sequence at SEQ ID NO. 2399
atggatttgatctctcaccaaccaaacaagaaccctaattcctcaacacaactaacaccaccttcctcaagccggtacgagaaccaaaaacgccgtgactggaacactttctgtcaatacctccggaaccaccgtcctccgctctctctcccctcgtgtagcggcgcacacgtgctcgagttcctccgctaccttgaccagttcgggaaaacaaaagttcaccaccagaactgtgccttctttggcctccctaaccctcctgctccttgtccttgtcctctccggcaagcttggggctcactcgacgctcttatcggccgcctccgcgccgcctacgaggagaacggtggcccacctgaagctaacccatttggctcacgcgccgtcaggttattcctccgtgaagtcagagactttcaagccaaagctcgaggtgttagctatgagaagaagaggaagagagtcaacaggcagaaaccgcaaacgcagccgcctctacagcttcagcaacagcaacagcagccacaacaaggtcagtctatgatggctaattactcgggtgcaacagtatga

SEQ ID NO: 2399 - protein, 190 aa, Arabidopsis thaliana
  misc_feature (7)..(139): Pfam Name: DUF640 Pfam Description: Protein of unknown function (DUF640)
  misc_feature (1)..(190): Ceres Annot ID no. 853637
  misc_feature (1)..(190): Bit score of 316.4 for HMM based on sequences of Figure 32
  misc_feature (1)..(190): Functional Homolog Of SEQ ID NO. 2271
MDLISHQPNKNPNSSTQLTPPSSSRYENQKRRDWNTFCQYLRNHRPPLSLPSCSGAHVLEFLRYLDQFGKTKVHHQNCAFFGLPNPPAPCPCPLRQAWGSLDALIGRLRAAYEENGGPPEANPFGSRAVRLFLREVRDFQAKARGVSYEKKRKRVNRQKPQTQPPLQLQQQQQQPQQGQSMMANYSGATV

SEQ ID NO: 2400 - protein, 175 aa, Vitis vinifera
  misc_feature (11)..(143): Pfam Name: DUF640 Pfam Description: Protein of unknown function (DUF640)
  misc_feature (1)..(175): Public GI ID no. 147795605
  misc_feature (1)..(175): Bit score of 283.6 for HMM based on sequences of Figure 32
  misc_feature (1)..(175): Functional Homolog Of SEQ ID NO. 2271
  misc_feature (175)..(175): Xaa is any aa, unknown, or other
MSNDRKRDSAEGSSRSTGEPQQQPQPLSRYESQKRRDWNTFGQYLKNQRPPVSLAQCSCNHVLEFLRYLDQFGKTKVHLHGCVFFGQPDPPAPCTCPLRQAWGSLDALIGRLRAAYEEHGGSPETNPFGNGAIRVYLREVRDCQSKARGIPYKKKKKKKNQIKPNNEAKSSKQSX

SEQ ID NO: 2401 - DNA, 531 bp, Populus balsamifera subsp. trichocarpa
  misc_feature (1)..(531): Ceres Annot ID no. 1482911
  misc_feature (1)..(531): Encodes the peptide sequence at SEQ ID NO. 2402
atgtcaagcaataaagggaaagatgtagcggaaggttcatcaagagctgttgctatggctcccgatcagcaaaatccacctcccttgagtcgatacgaatcgcagaagaggcgcgattggaacacctttggtcagtacttgaggaaccagagacccccagttgcattatcacagtgcaacgcaaatcatgtgcttgaatttcttcgatacctcgatcaatttggcaagactaaggtgcacttacaagggtgtgtcttttttggacaacctgagccgccagggccctgtacttgcccacttaagcaagcctggggtagccttgatgcactcatcggccggcttagggctgcttatgaagaaaatggtggcttgcctgagacaaacccttttgcaagtggtgctattagagtatatctacgtgaagtgagggactctcaggccaaggcaagaggaattccttataagaagaagaagaagaagaggaatccgatgaaagctaacgatgagagctcaagctttcatatgcagtaa

SEQ ID NO: 2402 - protein, 176 aa, Populus balsamifera subsp. trichocarpa
  misc_feature (13)..(145): Pfam Name: DUF640 Pfam Description: Protein of unknown function (DUF640)
  misc_feature (1)..(176): Ceres Annot ID no. 1482911
  misc_feature (1)..(176): Bit score of 292.9 for HMM based on sequences of Figure 32
  misc_feature (1)..(176): Functional Homolog Of SEQ ID NO. 2271
MSSNKGKDVAEGSSRAVAMAPDQQNPPPLSRYESQKRRDWNTFGQYLRNQRPPVALSQCNANHVLEFLRYLDQFGKTKVHLQGCVFFGQPEPPGPCTCPLKQAWGSLDALIGRLRAAYEENGGLPETNPFASGAIRVYLREVRDSQAKARGIPYKKKKKKRNPMKANDESSSFHMQ

SEQ ID NO: 2403 - DNA, 907 bp, Arabidopsis thaliana
  misc_feature (1)..(907): Ceres Annot ID no. 861920
  misc_feature (1)..(907): Encodes the peptide sequence at SEQ ID NO. 2404
attacataattcttcagatccataaaacaaattgatcccttaaccttcttcaccaacatctctcttacactcaacaagagatcatatcatgtcctctccaagagaaagaggaaagagtttgatggaatcatcaggatcagagccaccggtgacaccaagccgttacgagtcgcagaagagacgtgactggaacactttcggacagtacttgaagaatcagagaccgcctgtgccgatgtctcactgcagctgtaaccacgtgcttgatttcctcaggtacttagaccagttcggtaagacaaaggtgcacgtgcctggctgtatgttctacggccagcctgagccaccagctccttgcacgtgccctctcagacaagcttggggaagtcttgacgctttgatcggacggctgagagcggcttacgaggagaacggtggacctccggagactaaccctttcgctagcggagcgataagggtttatctgagggaggttagggagtgtcaggctaaggctagagggattccttacaagaagaagaagaagaagaagccaacgccggagatgggaggtgggagagaggactcttcttcctcctcctcttccttcagcttctcttaagagattctccatcgtcgtgaaagactttgtggatcagtaagtctcaaagagggatcaaatgtaaaagagacctcaaatctatctactggtatcttcaacatatctttcgggaccatttttgcagctcttcgtcccctcctcttcatttccgcagatctccgtcgtcataaatatcttcatctattctcttattaagctctattcatatttattctcttattaagcacttttcttttgaataaagtaagtgtaaagagtttatatattgaattcaggtgtgttttg

SEQ ID NO: 2404 - protein, 177 aa, Arabidopsis thaliana
  misc_feature (7)..(139): Pfam Name: DUF640 Pfam Description: Protein of unknown function (DUF640)
  misc_feature (1)..(177): Ceres Annot ID no. 861920
  misc_feature (1)..(177): Bit score of 293.8 for HMM based on sequences of Figure 32
  misc_feature (1)..(177): Functional Homolog Of SEQ ID NO. 2271
MSSPRERGKSLMESSGSEPPVTPSRYESQKRRDWNTFGQYLKNQRPPVPMSHCSCNHVLDFLRYLDQFGKTKVHVPGCMFYGQPEPPAPCTCPLRQAWGSLDALIGRLRAAYEENGGPPETNPFASGAIRVYLREVRECQAKARGIPYKKKKKKKPTPEMGGGREDSSSSSSSFSFS

SEQ ID NO: 2405 - protein, 177 aa, Vitis vinifera
  misc_feature (12)..(144): Pfam Name: DUF640 Pfam Description: Protein of unknown function (DUF640)
  misc_feature (1)..(177): Public GI ID no. 147776506
  misc_feature (1)..(177): Bit score of 287.8 for HMM based on sequences of Figure 32
  misc_feature (1)..(177): Functional Homolog Of SEQ ID NO. 2271
MGNKGKDTGEGSSTRSSAEDQQQQPPPLSRYESQKRRDWNTFGQFLKNQRPPVALAQCNSNQVLDFLRYLDQFGKTKVHLQGCVYFGQPEPPGPCTCPLKQAWGSLDALIGRLRAAYEENGGLPEKNPFASGAIRIYLREVRDSQAKARGVPYKKKKKKRNQMKANSDESNFPMQSM

SEQ ID NO: 2406 - DNA, 606 bp, Arabidopsis thaliana
  misc_feature (1)..(606): Ceres Annot ID no. 839537
  misc_feature (1)..(606): Encodes the peptide sequence at SEQ ID NO. 2407
atggatttgatctctcaaaaccacaacaacagaaaccctaataccagtctctcgacgcaaaccccttcttccttttcttctccaccttcctctagccgctacgagaaccagaaacgccgtgactggaacactttctgccaatacctcagaaaccaccatccaccgctctctctagcttcttgcagtggcgcacacgtcctcgattttctgcgttaccttgaccaattcggcaaaaccaaagtccaccaccaaaactgcgccttctttggcctcccaaatccaccggctccttgtccttgtcctctccgacaagcctggggctcactcgacgccctcattggtcgtctccgtgcagcctacgaggagaacggtggcgctcccgagactagcccttttggctcacggtccgtcaggattttcctcagggaggttagagatttccaggctaagtcacgtggtgttagctatgagaagaagaggaaaagggtcaacaacaagcaaataactcagtcccaaccacagtcccaaccgcctttaccccagcagccacagcaggagcaaggtcagtctatgatggctaattaccaccacggtgcaactcaataa

SEQ ID NO: 2407 - protein, 201 aa, Arabidopsis thaliana
  misc_feature (15)..(147): Pfam Name: DUF640 Pfam Description: Protein of unknown function (DUF640)
  misc_feature (1)..(201): Ceres Annot ID no. 839537
  misc_feature (1)..(201): Bit score of 311.2 for HMM based on sequences of Figure 32
  misc_feature (1)..(201): Functional Homolog Of SEQ ID NO. 2271
MDLISQNHNNRNPNTSLSTQTPSSFSSPPSSSRYENQKRRDWNTFCQYLRNHHPPLSLASCSGAHVLDFLRYLDQFGKTKVHHQNCAFFGLPNPPAPCPCPLRQAWGSLDALIGRLRAAYEENGGAPETSPFGSRSVRIFLREVRDFQAKSRGVSYEKKRKRVNNKQITQSQPQSQPPLPQQPQQEQGQSMMANYHHGATQ

SEQ ID NO: 2408 - DNA, 618 bp, Solanum lycopersicum
  misc_feature (1)..(618): Ceres Annot ID no. 8453882
  misc_feature (1)..(618): Encodes the peptide sequence at SEQ ID NO. 2409
atgtcaaatgatcaaataataatcgaaggcgaaggaggaggaggaggaggagaaggatcatcatcgagatccaaaaccactatacttatagcaccatctgacgatcatcatcatcatcatcagctaccaccagtaccacctcaactgagtagatatgagtctcagaaacgtcgcgattggaatacttttggacaatacttgaaaaatcaaaggccacctgttcctttatcccagtgtaactataaccacgtgctagagtttctccgatacctagatcaatttggaaaaactaaggtacatttacatggttgccctttttttggtcaaccagagcctccagggccttgtacttgtcctcttagacaagcatggggaagtcttgatgcacttattggtaggcttagagctgcctatgaagaaaatggtggcttacctgagaataatccattcgcgagtggagctatacgcgtttatcttagagaggtaagagattttcaagctaaagcaagaggaatttgttataagaagaagaagaagaagaggaaaatgcaaaacaaacctacttctagtaatgctcatgagccaactacaactacctttcaattccaatcttcttga

SEQ ID NO: 2409 - protein, 205 aa, Solanum lycopersicum
  misc_feature (33)..(165): Pfam Name: DUF640 Pfam Description: Protein of unknown function (DUF640)
  misc_feature (1)..(205): Ceres Annot ID no. 8453882
  misc_feature (1)..(205): Bit score of 293.1 for HMM based on sequences of Figure 32
  misc_feature (1)..(205): Functional Homolog Of SEQ ID NO. 2271
MSNDQIIIEGEGGGGGGEGSSSRSKTTILIAPSDDHHHHHQLPPVPPQLSRYESQKRRDWNTFGQYLKNQRPPVPLSQCNYNHVLEFLRYLDQFGKTKVHLHGCPFFGQPEPPGPCTCPLRQAWGSLDALIGRLRAAYEENGGLPENNPFASGAIRVYLREVRDFQAKARGICYKKKKKKRKMQNKPTSSNAHEPTTTTFQFQSS

SEQ ID NO: 2410 - DNA, 706 bp, Panicum virgatum
  misc_feature (1)..(706): Ceres Clone ID no. 1987520
  misc_feature (1)..(706): Encodes the peptide sequence at SEQ ID NO. 2411
actaccgccaccgccagcactgggaaagagtaagaagcagcagatgagatcaaccagcagcggctatcttccagaccattccaatacttactgatccttaaccctatcttcttgcttatgtatgattgcctctctgatgctccatggatgatcttgtgcagactcaagaagccaagcctccaattcgccatcagcgagatcgagctcggctgtgctaattccacccaaagctagctgatccatggacatgtcgccgaaccccgacagcccctcgtcgggagggggcaacggcggcatcgggtcgagcagcggcggcgcgtcgccgtccgttggttcgatgacgccgcagtcgccgagccggtacgaggcgcagaagcggcgcgactggaacacgttcgggcagtatctacggaaccaccggccgccgctgagcctggcgcagtgcagcggcgcccacgtcctcgagttcctccgctacctggaccagttcggcaagaccaaggtgcacggcccggcgtgccctttcttcggccacccgaacccgccggcgccgtgcccctgcccgctccgccaggcctggggcagcctcgacgccctcgtgggccgcctccgcgccgccttcgaggagaacggaggccgcccggaatccaaccccttcgccgcgcgcgccgtccgcctctacctccgcgaggtccgcgagcaccca

SEQ ID NO: 2411 - protein, 155 aa, Panicum virgatum
  misc_feature (22)..(154): Pfam Name: DUF640 Pfam Description: Protein of unknown function (DUF640)
  misc_feature (1)..(155): Ceres Clone ID no. 1987520
  misc_feature (1)..(155): Bit score of 232.9 for HMM based on sequences of Figure 32
  misc_feature (1)..(155): Functional Homolog Of SEQ ID NO. 2271
MDMSPNPDSPSSGGGNGGIGSSSGGASPSVGSMTPQSPSRYEAQKRRDWNTFGQYLRNHRPPLSLAQCSGAHVLEFLRYLDQFGKTKVHGPACPFFGHPNPPAPCPCPLRQAWGSLDALVGRLRAAFEENGGRPESNPFAARAVRLYLREVREHP

SEQ ID NO: 2412 - DNA, 534 bp, Populus balsamifera subsp. trichocarpa
  misc_feature (1)..(534): Ceres Annot ID no. 1466494
  misc_feature (1)..(534): Encodes the peptide sequence at SEQ ID NO. 2413
atgtcaggtgatcaaaggcctaaagattctgctgagggctcttcacgatctggcggcgatcactaccagcctcaaccggctcctttgagcaggtatgagtcgcagaaacggcgagactggaacacttttgggcagtacttgaagaatcagagacccccagtttcactatctcagagtaattgcaaccacgtccttgatttccttcggtatctcgatcagtttggcaagactaaggtccatctacatggctgtgtcttttttggacaacctaatcctcctgctccttgtacctgccctctaaggcaagcttggggaagccttgatgccctaatcggacggcttcgagcagcttatgaggagcatggaggatctgcagagactaacccttttggaaatggagctattcgggtttatttgcgtgaagtgaaagagtgccaagctaaggcaagggggattccatacaagaagaaaacgaagaagaagactcaaataagggcaagaaatgaagcgaagcctcctatgcagtcagcttaa

SEQ ID NO: 2413 - protein, 177 aa, Populus balsamifera subsp. trichocarpa
  misc_feature (13)..(145): Pfam Name: DUF640 Pfam Description: Protein of unknown function (DUF640)
  misc_feature (1)..(177): Ceres Annot ID no. 1466494
  misc_feature (1)..(177): Bit score of 277.1 for HMM based on sequences of Figure 32
  misc_feature (1)..(177): Functional Homolog Of SEQ ID NO. 2271
MSGDQRPKDSAEGSSRSGGDHYQPQPAPLSRYESQKRRDWNTFGQYLKNQRPPVSLSQSNCNHVLDFLRYLDQFGKTKVHLHGCVFFGQPNPPAPCTCPLRQAWGSLDALIGRLRAAYEEHGGSAETNPFGNGAIRVYLREVKECQAKARGIPYKKKTKKKTQIRARNEAKPPMQSA

SEQ ID NO: 2414 - DNA, 1003 bp, Arabidopsis thaliana
  misc_feature (1)..(1003): Ceres Annot ID no. 870022
  misc_feature (1)..(1003): Encodes the peptide sequence at SEQ ID NO. 2415
aagaccaaaagaaaaaaaaaaactttttcttttctgatgaatcgtatctattagctatgagcctgaggtgatgatcatgtcaacataaccatcaacgttctaccatggctagtcatagcaacaaaggcaaaggcatagcagaaggatcgtctcaaccgcaatcgcaaccgcaaccacaaccacaccaaccgcaatcacctcctaacccgccagcgttaagccggtacgagtcacagaaacgacgagactggaacacgttttgtcaatacctgcgtaaccaacagccaccggttcacatctcgcagtgtggatcaaaccacatcctcgatttcctccaatatctcgaccagtttgggaagacaaaggttcatatccatggatgcgttttcttcggacaggttgagccagcgggacagtgtaactgtcctttaaaacaagcgtgggggagtttagatgctttgatcggacggctaagagcggctttcgaggagaacggaggattgccggagagaaacccttttgccggcggcggaattagggtttttctgagggaagtgagagattcacaggcgaaggcaagaggagttccgtacaagaaaagaaaaaagaggaagaagaggaatcctatgaagagtcatgatggtgaagatggtactacgggaactagtagtagctccaacttggcttcttagcggaagcaaacaaaaaatctataataaaacaaagtggaattagttaatggtaagcatttaatactctccataatctctattaattttcagtactttaatcctattttgtgatctatttacaattttacatatagagtgaaaagaaacaattctacattcgtttcttgatagtcagctcttaatgcatagttgaattttatacgtatcatacccaaactataagattaatcttgatcttagatcatatacatatatcatcatggtgtgtaccctaagtttcataatcatttttcttaactatttatgtggat

SEQ ID NO: 2415 - protein, 195 aa, Arabidopsis thaliana
  misc_feature (22)..(154): Pfam Name: DUF640 Pfam Description: Protein of unknown function (DUF640)
  misc_feature (1)..(195): Ceres Annot ID no. 870022
  misc_feature (1)..(195): Bit score of 278.2 for HMM based on sequences of Figure 32
  misc_feature (1)..(195): Functional Homolog Of SEQ ID NO. 2271
MASHSNKGKGIAEGSSQPQSQPQPQPHQPQSPPNPPALSRYESQKRRDWNTFCQYLRNQQPPVHISQCGSNHILDFLQYLDQFGKTKVHIHGCVFFGQVEPAGQCNCPLKQAWGSLDALIGRLRAAFEENGGLPERNPFAGGGIRVFLREVRDSQAKARGVPYKKRKKRKKRNPMKSHDGEDGTTGTSSSSNLAS

SEQ ID NO: 2416 - DNA, 756 bp, Sorghum bicolor
  misc_feature (1)..(756): Ceres Annot ID no. 8744064
  misc_feature (1)..(756): Encodes the peptide sequence at SEQ ID NO. 2417
atgcaggtcggaggaggagcggccgacagccccggcgcggcggcgggcgcggaggcgccccgcccgagccgctacgagtcgcagaagcggcgggactggcacacgttcgggcagtacctgcgcaaccaccggccgccgctggagctggcgcggtgcagcggcgcgcacgtgctcgagttcctgcgctacctggaccagttcggcaagaccaaggtccacgcgccggggtgccccttcttcggccacccgtcgccgccggccccgtgcccgtgcccgctgcgccaggcctggggcagcctcgacgcgctcgtcggccgcctgcgcgccgccttcgaggagcacgggggacggcctgaggccaaccccttcggcgcgcgcgccgtgcgcctatacctccgcgaggccgcgacgaccccgccgcagcaggctcctcccgtctcctcgccggccctgtcggacgtggtgcccgagagggccgacgtgcgggcgcacgtgccggacgccgggcaccagcagcaccatcacctgcaccagcaccagcaccagcatcacttcttcatgccacacccgcagttcctgcacgggttcagcctgctgccgggcaaccccgaagcggtggctgccaatggcaacggcggcggcagcagcagcgctagcgtcgctgccggcaacggtgacgagatagcgctggcgatggcggcggcggcggaggcgcacgcggcggggtgcatgctgccgctgtcggtgttcaactag

SEQ ID NO: 2417 - protein, 251 aa, Sorghum bicolor
  misc_feature (6)..(138): Pfam Name: DUF640 Pfam Description: Protein of unknown function (DUF640)
  misc_feature (1)..(251): Ceres Annot ID no. 8744064
  misc_feature (1)..(251): Bit score of 265.7 for HMM based on sequences of Figure 32
  misc_feature (1)..(251): Functional Homolog Of SEQ ID NO. 2271
MQVGGGAADSPGAAAGAEAPRPSRYESQKRRDWHTFGQYLRNHRPPLELARCSGAHVLEFLRYLDQFGKTKVHAPGCPFFGHPSPPAPCPCPLRQAWGSLDALVGRLRAAFEEHGGRPEANPFGARAVRLYLREAATTPPQQAPPVSSPALSDVVPERADVRAHVPDAGHQQHHHLHQHQHQHHFFMPHPQFLHGFSLLPGNPEAVAANGNGGGSSSASVAAGNGDEIALAMAAAAEAHAAGCMLPLSVFN

SEQ ID NO: 2418 - DNA, 919 bp, Gossypium hirsutum
  misc_feature (1)..(919): Ceres Clone ID no. 1848017
  misc_feature (1)..(919): Encodes the peptide sequence at SEQ ID NO. 2419
attcctttcacctcccctttccccagcccccttataatttcttcttgccttatttagcaaaagataattaatcaatctgcctcgatctcaacaatatgtcgagtgaaagagggaaggatatagcggaaggaccatcaagggttaatcccggtgatcaacagctgcccccaacacctagccgctatgagtcacagaagagaagggactggaatactttcgggcagtacctgaagaaccagaggcccccagttcctctttctcagtgcaactgcaaccatgtgctggacttccttcgatatctggatcagttcggaaagaccaaggttcacctgcagggatgcatgttctatggacagcctgagccgcctgctccttgcacatgcccccttaggcaagcctggggcagcctcgatgctctaattgggaggcttcgagctgcttatgaagagaatggagggtcacctgagaccaacccttttgccagcggtgctattcgggtttatctcagagaggtcagggagtgtcaagccaaggcaagggggatcccttataagaagaaaaagaagaagccgcatcaaggcaagggaggtgatgaatccagctccaccattcacttctcttaatctttggacgatgtatgggattacatgagaaaaagaatcaaatggaagggaatataatatgataaaatccatcgaagattcagctcagtttgggggtttcggccttctttattagtatttttctttttcggtatttggcaatagctataatgaagggatcagttgagtgtacataactctcttgatcagtttctactttgtttgcgttttctcttttcatgaatgtccattttatgtctaagcttcctacgcaaaacattcatatcgtattgataataattagtcattttagtcgt

SEQ ID NO: 2419 - protein, 175 aa, Gossypium hirsutum
  misc_feature (11)..(143): Pfam Name: DUF640 Pfam Description: Protein of unknown function (DUF640)
  misc_feature (1)..(175): Ceres Clone ID no. 1848017
  misc_feature (1)..(175): Bit score of 287.2 for HMM based on sequences of Figure 32
  misc_feature (1)..(175): Functional Homolog Of SEQ ID NO. 2271
MSSERGKDIAEGPSRVNPGDQQLPPTPSRYESQKRRDWNTFGQYLKNQRPPVPLSQCNCNHVLDFLRYLDQFGKTKVHLQGCMFYGQPEPPAPCTCPLRQAWGSLDALIGRLRAAYEENGGSPETNPFASGAIRVYLREVRECQAKARGIPYKKKKKKPHQGKGGDESSSTIHFS

SEQ ID NO: 2420 - DNA, 1127 bp, Glycine max
  misc_feature (1)..(1127): Ceres Clone ID no. 1650005
  misc_feature (1)..(1127): Encodes the peptide sequence at SEQ ID NO. 2421
attccttctctcactcaccctcttatttcttcccaaaactccatatacatccatatctctatagccattaattcttctaccatagcacacagttaccaaaccaaaacatgtctactcaaattcaaaatggttcttcctcctcatcacaacaaccactgagtcgctatgagtcacaaaagcggcgagactggaacacctttggacagtacctgaggaatcagagtcccccagttccactctctcagtgcaacttcaaccatgtgttggatttccttcggtacctcgatcaatttgggaaaaccaaggtccacttgcacggttgcatcttctttggccagcccacccctcctgcaccctgtgcctgccctctcaggcaagcatggggtagcctcgatgccctcataggccggcttcgcgctgcctatgaggagcatggcggatcgccagagactaatccctttggaggaggagccattcgggtgtacctgcgtgaggtcaaggagtgtcaggcaaaggctagagggatcccatataagaagaagaagaagaagagaaacccaattctcaaggggactcaaagagctaaagatatcgagcaacaagcttcttgagatgatatatatctatatatatatatatatatatatgatatgaacgggccatatacgagcgagttaattggatatagcagatttggcactttgaaaaaagagcatctcagctgcttggaccaaaaattgttacagaaaatcagtgatatttcactaagtagttcagaacagaaaaatccttttaggcccatttactcgcagtaaatcttaaaatgcatgttagagatgtacaaccttgtaacttcttctaacatatgagacctctactccaaaatagaaacaacaagaatggctggctttacattcttgcagtagtttttccttatagtactttcaagcattatcaactacgcaaatatatctaggcattatattgaaagagttggaatttacattaatttggattaattagtacgttgtagtatgatgtcttaatcttgatgtgaacttcttggatttcaacttgatgcatatactgctgaaaatattcaatgtaaacttaattagcagagttgc

SEQ ID NO: 2421 - protein, 167 aa, Glycine max
  misc_feature (1)..(133): Pfam Name: DUF640 Pfam Description: Protein of unknown function (DUF640)
  misc_feature (1)..(167): Ceres Clone ID no. 1650005
  misc_feature (1)..(167): Bit score of 263.9 for HMM based on sequences of Figure 32
  misc_feature (1)..(167): Functional Homolog Of SEQ ID NO. 2271
MSTQIQNGSSSSSQQPLSRYESQKRRDWNTFGQYLRNQSPPVPLSQCNFNHVLDFLRYLDQFGKTKVHLHGCIFFGQPTPPAPCACPLRQAWGSLDALIGRLRAAYEEHGGSPETNPFGGGAIRVYLREVKECQAKARGIPYKKKKKKRNPILKGTQRAKDIEQQAS

SEQ ID NO: 2422 - DNA, 534 bp, Populus balsamifera subsp. trichocarpa
  misc_feature (1)..(534): Ceres Annot ID no. 1449022
  misc_feature (1)..(534): Encodes the peptide sequence at SEQ ID NO. 2423
atgtcaggtgatcaaaggcctaaagattctgctgaaggctcttcgcgatctggaggcgatcaccaccagcttcaatcagctcctttgagccggtatgagtcgcagaaacggcgagactggaacactttcgggcagtacttgaagaatcagagacccccagtttcattatctcagtgtaattgcaatcatgtgcttgatttccttcggtatcttgatcagtttggcaagactaaggttcatctacatgggtgcgtcttctttggacaacctgatcctcctgctccttgtacatgccctctaaggcaagcttgggggagccttgatgccctaatcggacgccttcgagcagcttttgaggagcatggaggatcagcggagactaacccttttggaaatggagctattcgggtttatttgcgtgaagtgaaagagtgtcaagctaaggcaagagggattccttacaagaagaagaagaagaagaagactcaaataaggccaagagacgaagcaaagccttcgatgcagacagcttaa

SEQ ID NO: 2423 - protein, 177 aa, Populus balsamifera subsp. trichocarpa
  misc_feature (13)..(145): Pfam Name: DUF640 Pfam Description: Protein of unknown function (DUF640)
  misc_feature (1)..(177): Ceres Annot ID no. 1449022
  misc_feature (1)..(177): Bit score of 277.3 for HMM based on sequences of Figure 32
  misc_feature (1)..(177): Functional Homolog Of SEQ ID NO. 2271
MSGDQRPKDSAEGSSRSGGDHHQLQSAPLSRYESQKRRDWNTFGQYLKNQRPPVSLSQCNCNHVLDFLRYLDQFGKTKVHLHGCVFFGQPDPPAPCTCPLRQAWGSLDALIGRLRAAFEEHGGSAETNPFGNGAIRVYLREVKECQAKARGIPYKKKKKKKTQIRPRDEAKPSMQTA

SEQ ID NO: 2424 - DNA, 1668 bp, Arabidopsis thaliana
  misc_feature (1)..(1668): Ceres Annot ID no. 837788
  misc_feature (1)..(1668): Ceres SEED LINE ID no. CW00232
  misc_feature (1)..(1668): Encodes the peptide sequence at SEQ ID NO. 2425
atggacaatgagaaagggacaagttcctcggatttaacgacgagacaaaggaagcctcttggttggaaagcgatgccttatatcatagggaatgaaacattggagaggcttgccacattcggtttgatggcgaatttcatggtgtatatggtaagagagtatcatatggaccaagttcaagctgtcactcttatcaacacttggtctgctctcaccaactttgctcctatcatcggagctttcatctccgactcctacaccggaaaatttaataccattgtcttcggttccatcgctgagttgttgggcatgttggtgttgactttcacgtctctggtccctaatctacgaccaccaccttgcactgccgaccaaatcactggacaatgtattccctatagctattcgcagttatacgttttactctcaggacttttcttgttatcagttggaacaggtggaatccggtcatgcagtgttcctttcagtctcgatcagttcgatgattcgactgaagaaggaagagaaggaagtagaagcttctttagctggtactataccactcatacaatcgtccagttagtttcaatgacactagtgttgtacgtacagaacaacatcagttggggcattggattcgcaatcccgaccgttctcaatttttttgcgcttcttctgctttttgtgggtactcggtattatgtctttgtcaaacccgaaggaagtgtcttctctggagttttcaaggttcttgtggctgcttataagaaacgcaaggcacggtttacttctggaattgactaccatcaacccttactagagacagatttacaatcaaataaactcgtactcactgatcaattcagattcttgaacaaagctgtgatagtgatgaacaatgatgaagctggaaatgaggagtggagaacctgcacagtgagacagatagaggacatcaagtcaataatcagtattattccaatatttgcttcgagcattattggatttttggctatgaaccaacaacagacgtttacagtctcacaagcactaaaaatggacctccaatttccaggcacttcttacctaatccctcctgcttctataaccgtcatatcattattaaacataggtatatggcttcccttctatgaaaccgttttggtccgacacatcgaaaacattacaaaacaaaacggaggtatctcgttactacaaaaagtcggcattgggaatattttctccatctcgacgatgctcatatccggtattgtggagcgaaagagaagagatttatcgcttaatggagtaaaaatgtcggttttctggctaaccccgcaacaagtactaatgggattttatcaagtcttcacgattgttggtctcaccgagttcttcaacaaacaagttccaatcaacatgagaagcattgggaactcgttgctttacttaggtttgtctctagccagttatctaagcagtgccatggtgagcattgttcatagtgtgactgctcgtggaggacagagttggctaacggatgatattgacaaaagcaagttggattgtttctattactttattgccgctttaagcactcttaatttcatcttcttcttctggtgtgctcgaaggtatcgttacagaaactatagtaatgaacaataa

SEQ ID NO: 2425 - protein, 555 aa, Arabidopsis thaliana
  misc_feature (90)..(486): Pfam Name: PTR2 Pfam Description: POT family
  misc_feature (1)..(555): Ceres SEED LINE ID no. CW00232
  misc_feature (1)..(555): Ceres Annot ID no. 837788
  misc_feature (1)..(555): Bit score of 1422.7 for HMM based on sequences of Figure 38
  misc_feature (1)..(555): in Figure 38
MDNEKGTSSSDLTTRQRKPLGWKAMPYIIGNETLERLATFGLMANFMVYMVREYHMDQVQAVTLINTWSALTNFAPIIGAFISDSYTGKFNTIVFGSIAELLGMLVLTFTSLVPNLRPPPCTADQITGQCIPYSYSQLYVLLSGLFLLSVGTGGIRSCSVPFSLDQFDDSTEEGREGSRSFFSWYYTTHTIVQLVSMTLVLYVQNNISWGIGFAIPTVLNFFALLLLFVGTRYYVFVKPEGSVFSGVFKVLVAAYKKRKARFTSGIDYHQPLLETDLQSNKLVLTDQFRFLNKAVIVMNNDEAGNEEWRTCTVRQIEDIKSIISIIPIFASSIIGFLAMNQQQTFTVSQALKMDLQFPGTSYLIPPASITVISLLNIGIWLPFYETVLVRHIENITKQNGGISLLQKVGIGNIFSISTMLISGIVERKRRDLSLNGVKMSVFWLTPQQVLMGFYQVFTIVGLTEFFNKQVPINMRSIGNSLLYLGLSLASYLSSAMVSIVHSVTARGGQSWLTDDIDKSKLDCFYYFIAALSTLNFIFFFWCARRYRYRNYSNEQ

SEQ ID NO: 2426 - protein, 619 aa, Vitis vinifera
  misc_feature (124)..(534): Pfam Name: PTR2 Pfam Description: POT family
  misc_feature (1)..(619): Public GI ID no. 225424885
  misc_feature (1)..(619): Bit score of 1706.8 for HMM based on sequences of Figure 38
  misc_feature (1)..(619): Functional Homolog Of SEQ ID NO. 2425
  misc_feature (1)..(619): in Figure 38
MSTVDAKHQASPLTSSWSSSPPPKSKPLDNEPEKSKHDAVVSSDVSDEGPRKPGGWNSMVYILGNETFERLATFGLLANFMVYLLNEFHLDQVYATNVLNIWSGTTNFAPLVGAFISDACVGRFRTIAFASFASLLGMVTLTLTSWIPQLHPPSCTEDQQQNDQCTGPTSAQMGILFLGLGFLTIGTGGIRPCSIPFGVDQFDPTTEQGRRGINSFYNWYYTSFTLVLMIALTLVVYIQDSVSWVLGFGIPTLLMVGSIILFFLGTRVYVYVKPEGSIFSGIARVFVAAYKKRRVKIPVEGEKEGAYYDPPLTKGSIVAKLPFTKRFRWLNKAAVILEGEKDANGCPSNQWRLCSIQQVEEVKCLLKIIPVWASGIICFTAISQQGTFTVSQALKMDRHLGPKFQIPAGSLIVISMLTVGIWVPFYDRILVPALQKITKHEGGITLLQRMGIGIVFSILSMVVSGLVERERRASAILQAGPHGIAPMSVMWLAPQLILMGFAEAFNIIGQIEFYNKEFPENMRSIANSLFFCTIAGASYLSSLVVVIVHDVTGKAGRSAWLTKNINQGKVDYYYYLLAGMGVLNLIYFLFCARRYRYKSGHGVTEEEPHLDLELNQLKH

SEQ ID NO: 2427 - DNA, 1914 bp, Populus balsamifera subsp. trichocarpa
  misc_feature (1)..(1914): Ceres Annot ID no. 1513435
  misc_feature (1)..(1914): Encodes the peptide sequence at SEQ ID NO. 2428
atggctgaagatgaaaagaagggcacaagctcatacaggctatattgctccataaaatgcttccaaaaaccatcatcaccggagcagaagcacggcaaccttgcagaaactgagcagaagaagcccggaggatggagagccatgccttttatcttaggaaatgagacttttgagaggctggctacttttggcttgttagccaacttcatggtgtatttgatgagagtctttcacttggagcaggtgactgctgcaaacgtcataaacatctggtctggtgtaactaatttcgcaccgttggttggtgcattcatctctgatgcctatgtgggcaggtttaagaccattgcttttgcatcctgtgcagctttcctgggaatggtgactgtgacttcgacggcatgggtgccttatcttcaccctcaaaaatgcgagcctgaaggaaagcagcagtcttatgggaactgtgaaagtcccaccagcatgcaattgggtgttctgttgcttggcttagggttcctatctatcggaacaggtgggattaggccatgcagcattccgtttggtgttgatcagtttgaccctacaactgaagaagggataaaagggattagcagctactacaattggtattatacaaccttcacggtggtgatgttgatcactttaaccgcagtggtatatgttcaagactctgttagctgggttttgggttttggaatacctactgtgcttatgctctgctccatcatactcttcttcattggaacaaggatttatgtgcatgtaaagccagaaggaagtgttttctctggcattgcacaggtttttgtttctgcttataaaaagcgtaggcttaagcttcctgacaattgtgatggagagcaggttgatgggatcttttatgatcctccaattaaagatcaattaacaatattgtcaaagctccctcttaccaatcagatcaggtttttgaacaaggctgcaatgatagagaaagaaactgacctcaagccagatggttcgtgtgctaagcaatggagattgtgcagtgtccaacaggttgaagaggtgaaatgcctgataaaaataggtccaatatgggcttctagtattgttagcttgacttcaatggtacaacaaggaacatttactgtgtctcaagccttgaaaatggacagacaccttggagaaaaattccaaatcccagctagttccatcatcgtcgtgtcgttgataacaataggaatatggctcccattctatgacagagtcctagtgccagccattcgaaaagtaacaaaacatgaaggtggaatcacaattctccaaagaattggaattgggaatgtattctctgttctatcaatggtagtagctggattggtggagagggagagaagagctgcagcaatttcacacccagaggctgcacccatgtcagtcttttggctagctccacaacttgtggtaatggggttatgcgaggcattcgttggcactggacaaattgaattttacaacaagcagtttcctgatcacatgagaagcctcggtaactctcttttcttctgctcatttgctggtgcaagttaccttagtaccatgttgggcagcattgttcataaggttactggaacgagacaccatccagactggctgacaaatgatctaaatgctgggaatttggattacttctacttccttttggcaggaatgggggttgtcaattggttttattttctgctttgtgctcatcgatatcgttacaagataatggtagatgctcatcatgatttgcgcgccaactcggttgtaaattgtggagtattttgcgtcagatggagagataagcccacttggcgaaaagcgtggagcctcacaatacgtcaccagcgttgtggcaatgattag

SEQ ID NO: 2428 - protein, 637 aa, Populus balsamifera subsp. trichocarpa
  misc_feature (113)..(527): Pfam Name: PTR2 Pfam Description: POT family
  misc_feature (1)..(637): Ceres Annot ID no. 1513435
  misc_feature (1)..(637): Bit score of 1799.7 for HMM based on sequences of Figure 38
  misc_feature (1)..(637): Functional Homolog Of SEQ ID NO. 2425
  misc_feature (1)..(637): in Figure 38
MAEDEKKGTSSYRLYCSIKCFQKPSSPEQKHGNLAETEQKKPGGWRAMPFILGNETFERLATFGLLANFMVYLMRVFHLEQVTAANVINIWSGVTNFAPLVGAFISDAYVGRFKTIAFASCAAFLGMVTVTSTAWVPYLHPQKCEPEGKQQSYGNCESPTSMQLGVLLLGLGFLSIGTGGIRPCSIPFGVDQFDPTTEEGIKGISSYYNWYYTTFTVVMLITLTAVVYVQDSVSWVLGFGIPTVLMLCSIILFFIGTRIYVHVKPEGSVFSGIAQVFVSAYKKRRLKLPDNCDGEQVDGIFYDPPIKDQLTILSKLPLTNQIRFLNKAAMIEKETDLKPDGSCAKQWRLCSVQQVEEVKCLIKIGPIWASSIVSLTSMVQQGTFTVSQALKMDRHLGEKFQIPASSIIVVSLITIGIWLPFYDRVLVPAIRKVTKHEGGITILQRIGIGNVFSVLSMVVAGLVERERRAAAISHPEAAPMSVFWLAPQLVVMGLCEAFVGTGQIEFYNKQFPDHMRSLGNSLFFCSFAGASYLSTMLGSIVHKVTGTRHHPDWLTNDLNAGNLDYFYFLLAGMGVVNWFYFLLCAHRYRYKIMVDAHHDLRANSVVNCGVFCVRWRDKPTWRKAWSLTIRHQRCGND

SEQ ID NO: 2429 - DNA, 1794 bp, Solanum lycopersicum
  misc_feature (1)..(1794): Ceres Annot ID no. 8458807
  misc_feature (1)..(1794): Encodes the peptide sequence at SEQ ID NO. 2430
atgtccttccccttgccggaaaatggtgtctccgatgaggaaaaacagacctccggtagtgattctccggccaaaacacgccggagaaaacccgggggatggagagctatgccttatgttctaggaaatgagacatttgagagattggcatcaatagggttaatagcaaatttcatgcaatttttattacaagtatttcatttggaccaagtttctgcctccaatgttcttaatatatggtctggtgttactaatttcataccattaattggtgcttttatttccgatgcatatattggtcgattttggactattgcttctgcctccattttcgaaatgatgggaatgttgacattaaccatgataccttggttacctaagctacaccctcctccttgcaaattgggccaacaatgcaaaaagcccaacaaatcacaaatgggctttttagtaatgggcttgggctttttatccattggatctgctggaataaggccttgtagtatcccatttggtgtagaccaatttgactcaacaacagatgaaggaagaaaagggattgctagtttcttcaactggtattacacttcttttacattggttttgataatcgcagtcacacttgttgtgtatatacaagattcagtgagctgggtgctcggattcggtatccctacgatactcattttcttgtctatcgttttatttttcatcgggactaaagtctacgttcatgtcaagcctcaaggaagtgtattctcgagcttcattcaagtttttgtagcgtcttataagaaacgcaacctaaagctccctgatgaacgtgagagtaacgtgacggtcttttatgatcctctgttacctcaagggtctattgtgaacaaactccctttaacccataagcacaggtggttgaataaagcagcgatagtgatgaaggatgaagtgaacagagacggcgattgtacaaacaaatggagattatgcagtatccagcaaatcgaagaagtgaaatgtgtactcaaaataatcccaatttggtctgcaggggttatctgtttcacagcaatggcacaacagggcacattcacaatctcacaagctctaaaaatggatcgtcatctcggccctaatttccagatcccaccaggttccctctctgtaatatcgatgatcacagttgggatatggttaccagtctacgatagactcatcgtgccatcgcttacaaaagtaacacgaatagaaggtgggatcacattgctacatagaattggaattggaatcgcattttcgattctgtcaatggtcgtagctgggataactgaaaaaatgagaagaaattccgccataactcacaatagccctgatgggatcgcaccagttacagtaatgaggttagctcctcaactagtgttaatgggattcgcggaggcgttcaacatacttggacagattgaattttacaataaggaattccccgaaaacatgagcagtgtggctaattctctgttttcatgtactgttgctggtgcaagttacctaagcagtttgctagtgaacgttttgcataacactacgggaggaaatgggcatctagattggttaacgaatgatattaataagggtcgaatagactattactactatcttatcgcggggttaggtgtgttgaacttgttctattttctatacgttgctagtcgatatgagtataagactagagtagtgatcgatgatgatcgaattaagggttatggtgatgatcatgaacttcatgacatgaagtattaa

SEQ ID NO: 2430 - protein, 597 aa, Solanum lycopersicum
  misc_feature (102)..(509): Pfam Name: PTR2 Pfam Description: POT family
  misc_feature (1)..(597): Ceres Annot ID no. 8458807
  misc_feature (1)..(597): Bit score of 1623.3 for HMM based on sequences of Figure 38
  misc_feature (1)..(597): Functional Homolog Of SEQ ID NO. 2425
  misc_feature (1)..(597): in Figure 38
MSFPLPENGVSDEEKQTSGSDSPAKTRRRKPGGWRAMPYVLGNETFERLASIGLIANFMQFLLQVFHLDQVSASNVLNIWSGVTNFIPLIGAFISDAYIGRFWTIASASIFEMMGMLTLTMIPWLPKLHPPPCKLGQQCKKPNKSQMGFLVMGLGFLSIGSAGIRPCSIPFGVDQFDSTTDEGRKGIASFFNWYYTSFTLVLIIAVTLVVYIQDSVSWVLGFGIPTILIFLSIVLFFIGTKVYVHVKPQGSVFSSFIQVFVASYKKRNLKLPDERESNVTVFYDPLLPQGSIVNKLPLTHKHRWLNKAAIVMKDEVNRDGDCTNKWRLCSIQQIEEVKCVLKIIPIWSAGVICFTAMAQQGTFTISQALKMDRHLGPNFQIPPGSLSVISMITVGIWLPVYDRLIVPSLTKVTRIEGGITLLHRIGIGIAFSILSMVVAGITEKMRRNSAITHNSPDGIAPVTVMRLAPQLVLMGFAEAFNILGQIEFYNKEFPENMSSVANSLFSCTVAGASYLSSLLVNVLHNTTGGNGHLDWLTNDINKGRIDYYYYLIAGLGVLNLFYFLYVASRYEYKTRVVIDDDRIKGYGDDHELHDMKY

SEQ ID NO: 2431 - protein, 587 aa, Oryza sativa subsp. japonica
  misc_feature (106)..(501): Pfam Name: PTR2 Pfam Description: POT family
  misc_feature (1)..(587): Public GI ID no. 115489782
  misc_feature (1)..(587): Bit score of 1515.7 for HMM based on sequences of Figure 38
  misc_feature (1)..(587): Functional Homolog Of SEQ ID NO. 2425
  misc_feature (1)..(587): in Figure 38
MDAAAAMEKQQQPGEKKITGGEEEEEEEVISSVRYRGWKSMPYVIGNETFEKLGTIGTTANLLVYLTTVYHLPSVRAATLLNFFSGTTNLAPLLGAFLSDTFLGRYTTIAAASLASCLGMLVLTLTAAIPSLHPPPCTASSSSSSCQGPTHGQLAALLAAFAFLVVGAGGIRPCNLAFGADQFDPRTDSGRRGIASFFNWYYFTFTVAMMLSATLIIYLQSNVSWAIGLAVPAALMAISCALFFMGTRLYVRVRPEGSPFTSFARVIVAAVRKRRVPAPASADDLFDPPHQSKLVAKIAYTDQFRCLDKAAVVTPESRSSPWRLCTVQQVEEVKCLARIIPVWSAGIVYFIVVTQLGTFVVLQALQMDRRLTRWWAFEVPAGSMVVFNMMAMTVWIPVYDRVVVPALRRVTGKEGGISQLQRIGVGLVLSVATMVVAAAVEQRRRRLGAVGVKMSFLWLVPQQVAAGMSEAFAAIGQTELYYRQFPENMRSVAGALFFLAFALANYASGFMVAAVHRTTGWLAQDLNHARLDLFYLTVAAIAAANVCYFLLCARWYRFKNTTIADHVELPDYHHHQPGTANTIASKV

SEQ ID NO: 2432 - DNA, 1782 bp, Sorghum bicolor
  misc_feature (1)..(1782): Ceres Annot ID no. 8633356
  misc_feature (1)..(1782): Encodes the peptide sequence at SEQ ID NO. 2433
atgcgcgtgggcggcgggcgggacgacgaggaggtgtcccggaagctcaagagcatggacgtcgacaagctggagaacggcggcggcggcggcgaggagagcccgcacccgccgcggcccgccgtcaagtaccatggctggaaggccatgcccttcatcatcgggaacgagacgttcgagaagctggggacgctgggcacgtcggcgaacctgctggtgtacctgacgcaggtgttccacatgcggagcgtggacgcggccacgctgctcaacgggctcaacggcaccaccagcctcgcccccatcatcggcgccttcctctccgacgcctacctcggccgctacctcgcgctcgccatcgcctccgtcgcctccctcatcggcatgttcctgctgacgctgacggccggcgcggacagcctgcacccgccggagtgcaacgtgggcgagacctgcgagaaggcgacgtcgtaccagttcgcggtgctcttcatcgccttcgcgttcctggtgctggggtcggcggggatccgcccctgcagcatgcccttcggcgccgaccagttcgaccccaccacggagtccggcaagcgcggcatcaacagcttcttcaactggtactacttcaccttcacggcggccatgatggtctccgccaccgtcatcatctacgtgcagagcaacgtgagctggcccatcgggctgggcatcccgacggcgctcatgttcctggcctgcgtgctcttcttcatgggcacgcgcctctacgtgcgtgtgacgcccgaggggagccccttcaccagcgtcgtccaggtgctgtcggccgcgctcaagaagcggtcgctgaagcagcccaaggacccgaagcaggacctcttcgacccgccgcacaccagcgccatcgtcaccaagctcgcgcacacggaccagttccgatgcctcgacaaggcggccatcgtggcgtcccaggacgaggtgcgccccggcggcgccgcgcctgccgacccatggaggctctgcagcgtacagcaggtggaggaggtcaagtgcctcatccgcatcgtgcccgtctggtccacggggatcatctactacgtcgccgtggtgcagcagtccacgtacgtggtgctctcggcgctgcagtccgaccgccacctcggccgcggcggcttccagatccccgccgcgtcgttcaccgtcttcgccatgctcgcgcagacgctgtggatcccattctacgaccgtctcctgctgcccaagctccgcaagataacgggcaaggaggaggggttcacgctgctccagcgccagggcatcggcatcgcgctctccaccgtggccatggtcatctcggcaatcgtcgaggaccggcgccgtgccatcgcactgagccagccgacgctgggaaccaccatcaccggcggggcgatctcggccatgtccagcctgtggatggtgccgcagctcatgatcctggggctgtcggaggcattcaacctcatcagccagatcgagttctactacaaggagatcccggagcacatgcgcagcgtggcaggggcgctcgccttctgcaacctggcgctcggcaactacctcagcggcttcctggtgaccatcgtgcaccggaccacggggtccgggcagaactggctggcgcaagacctcaacaagggccgcctcgacctcttctactggaccatcgccggcatcggcgtctttaacctcatctacttcgtcatctgcgccaggtggtacaggttcaagggggccagcaactaa

SEQ ID NO: 2433 - protein, 593 aa, Sorghum bicolor
  misc_feature (117)..(527): Pfam Name: PTR2 Pfam Description: POT family
  misc_feature (1)..(593): Ceres Annot ID no. 8633356
  misc_feature (1)..(593): Bit score of 1553.1 for HMM based on sequences of Figure 38
  misc_feature (1)..(593): Functional Homolog Of SEQ ID NO. 2425
  misc_feature (1)..(593): in Figure 38
MRVGGGRDDEEVSRKLKSMDVDKLENGGGGGEESPHPPRPAVKYHGWKAMPFIIGNETFEKLGTLGTSANLLVYLTQVFHMRSVDAATLLNGLNGTTSLAPIIGAFLSDAYLGRYLALAIASVASLIGMFLLTLTAGADSLHPPECNVGETCEKATSYQFAVLFIAFAFLVLGSAGIRPCSMPFGADQFDPTTESGKRGINSFFNWYYFTFTAAMMVSATVIIYVQSNVSWPIGLGIPTALMFLACVLFFMGTRLYVRVTPEGSPFTSVVQVLSAALKKRSLKQPKDPKQDLFDPPHTSAIVTKLAHTDQFRCLDKAAIVASQDEVRPGGAAPADPWRLCSVQQVEEVKCLIRIVPVWSTGIIYYVAVVQQSTYVVLSALQSDRHLGRGGFQIPAASFTVFAMLAQTLWIPFYDRLLLPKLRKITGKEEGFTLLQRQGIGIALSTVAMVISAIVEDRRRAIALSQPTLGTTITGGAISAMSSLWMVPQLMILGLSEAFNLISQIEFYYKEIPEHMRSVAGALAFCNLALGNYLSGFLVTIVHRTTGSGQNWLAQDLNKGRLDLFYWTIAGIGVFNLIYFVICARWYRFKGASN

SEQ ID NO: 2434 - DNA, 2167 bp, Arabidopsis thaliana
  misc_feature (1)..(2167): Ceres Annot ID no. 868948
  misc_feature (1)..(2167): Encodes the peptide sequence at SEQ ID NO. 2435
actacacccaaaaaagcttctaacaaagagaaagtgtctgtatgttgtgcccactctctacatttatcaatcacttcatgtgtgttaccttgattgcaaaaaagtgagaatatattctcacaacattaaatccaccccgaaatcgaagtgagtatatcacgagtgtagtaatatcttagagatggttttggaggatagaaaggacggttcttctttgccgggacgatccggtagtttctctaaatcgtcaccgtcggagttggatgttgttgatccctacaagcggataagttcgccgggatctatattggatgctgagaaggtagagaaaaagcctggaggatggagagccgtctcgttcattttaggaaatgagacgctggagagactgggatcgataggattgttggcaaacttcatggtttatctaaccaaagtgtttcacttagaacaagtcgacgctgcaaatgtcatcaacatttggtcaggtttcaccaatctcactcctctcgtcggagcgtatatctcagacacttatgttggccgcttcaagaccatcgctttcgcctcattcgccactctcctcggactaataacaattacactcacagcatcgtttcctcaactccacccagcatcatgcaacagccaggacccactcagttgcggcggtccgaataagctccagatcggagttttgctattgggactctgtttcctctccgtagggagtggaggaatacgaccttgtagcatcccttttggggttgatcagtttgaccaacgaactgaggaaggggttaaaggagtggccagtttcttcaactggtattacatgactttcactgtggttctgatcattacacagaccgtagttgtgtatatccaggatcaagtcagttggattatcggttttagtatccctaccggactcatggctcttgcggttgttatgttttttgccggaatgaagcgttatgtctacgttaaaccagaaggaagtatattctctgggatcgctcaagttatcgtggcagctcgtaagaagcgaaagctgaaacttccggcggaagatgacggcactgtcacctattacgacccagccatcaagtctagcgtgttatccaagttacaccgcagtaaccaattcaggtgtcttgacaaagccgcggtggttatagaaggtgacctaacacccgagggacctcccgcagacaagtggcggttatgcagcgtccaagaagtggaagaagtgaagtgtttgatccgaattgttcctatctggtcggccggaataatctcactcgcggccatgacaacacaaggcactttcacggtctctcaagctttgaaaatggatcgaaacttaggtcctaaattcgagattccggctggttcactctccgtcatctctctcctcacaatcggcatctttcttcccttctacgaccgcgtttttgtaccattcatgcggcgaatcaccggccataaatccggaatcacactcctccaaaggataggaacagggatcgttttcgcgatcttttctatgatcgttgcgggcattgtggagcgtatgagacgcatacgctccatcaatgccggagatccaacgggaatgactccaatgtcggtgttttggctttcgccgcagctaattctcatgggactatgtgaagcattcaatatcatcggacaaattgagttcttcaacagtcagtttccagagcacatgagaagtatcgctaactctctcttctctttatcgttcgccggttcgagctaccttagtagtttccttgtgactgtcgttcataaattctccggtgggcatgatcgtccggattggctaaacaagaatctcaacgcgggaaaattggattacttctattatctgattgcggttttgggtgtggttaatctggtttacttttggtattgtgctcggggataccggtacaaggtcggtttaccgattgaagactttgaggaggacaagtcctccgatgatgttgagatgacttcgaagaaatcgatgaaatgatttaatagactatccttagggacaacaagaagattgtcgatgttgtttgaataattactatgacaatgtatgtatcataatatgtaagaactagaatatttaataaaattttacctttcatta

SEQ ID NO: 2435 - protein, 620 aa, Arabidopsis thaliana
  misc_feature (123)..(530): Pfam Name: PTR2 Pfam Description: POT family
  misc_feature (1)..(620): Ceres Annot ID no. 868948
  misc_feature (1)..(620): Bit score of 1219.8 for HMM based on sequences of Figure 38
  misc_feature (1)..(620): Functional Homolog Of SEQ ID NO. 2425
MVLEDRKDGSSLPGRSGSFSKSSPSELDVVDPYKRISSPGSILDAEKVEKKPGGWRAVSFILGNETLERLGSIGLLANFMVYLTKVFHLEQVDAANVINIWSGFTNLTPLVGAYISDTYVGRFKTIAFASFATLLGLITITLTASFPQLHPASCNSQDPLSCGGPNKLQIGVLLLGLCFLSVGSGGIRPCSIPFGVDQFDQRTEEGVKGVASFFNWYYMTFTVVLIITQTVVVYIQDQVSWIIGFSIPTGLMALAVVMFFAGMKRYVYVKPEGSIFSGIAQVIVAARKKRKLKLPAEDDGTVTYYDPAIKSSVLSKLHRSNQFRCLDKAAVVIEGDLTPEGPPADKWRLCSVQEVEEVKCLIRIVPIWSAGIISLAAMTTQGTFTVSQALKMDRNLGPKFEIPAGSLSVISLLTIGIFLPFYDRVFVPFMRRITGHKSGITLLQRIGTGIVFAIFSMIVAGIVERMRRIRSINAGDPTGMTPMSVFWLSPQLILMGLCEAFNIIGQIEFFNSQFPEHMRSIANSLFSLSFAGSSYLSSFLVTVVHKFSGGHDRPDWLNKNLNAGKLDYFYYLIAVLGVVNLVYFWYCARGYRYKVGLPIEDFEEDKSSDDVEMTSKKSMK

SEQ ID NO: 2436 - DNA, 2085 bp, Brassica napus
  misc_feature (1)..(2085): Ceres Clone ID no. 1381517
  misc_feature (1)..(2085): Encodes the peptide sequence at SEQ ID NO. 2437
accctaaaaagattctaacagagagaaagtgtacgcgtgacgtgcccactcgctacatttatcaatcattccatgtgtttaccttgatttatctatgtaaattgcataaaagtaaggatccaatctcacaacatcaattgccctaagttcaaagtgcgaagagaaggacacttcttcttcccaccatctagtaatttctccaaatcgctactgccggcggagatggatgtttctgattctcacagtcagaaaagttcgccgcattctatcttggatgctgagaaggttgagaaaaagcctggaggatggagagccgtcacgttcattttaggaaatgagacgttggagagactgggaacaattgggttgttgtcaaacttcatggtgtatctaaccagagtgttccacttagaacaagtcgacgcttcaaatgtcatcaacatttggtctggcttcagcaatctcactcctctagtgggtgcgtttatctcggacgcttacgtcggccgtttcaagaccatcgctttcgcctcattcgccaccctcctcggactagtgacattgacactcacggcatcgcttcctcaactccacccagaaacatgcaacagcaaagatcccgttagttgcggcggtccgaacaaactccagttcgggattttgctattaggtctaggtttcctctccatagggagtggaggaatacgaccatgtagcatcccttttggtgttgaccaattcgaccaacgaaccgaggaagggattaaaggagtggcaagtttcttcaactggtattacatgactttcactgtggttctgattattacacagaccgttgttgtgtatatccaagaccaagtcagctggatcatcggctttagcgtacccactggactcatggcttgtgccgtggttatgtttttcgccggaatgaagctttacgtctatgttaaacctgaaggaagtatattctctggtatcgctcaagttgtcgtggcagctcgcaagaagcgaaagatgaagctcccggcggaagatgacggcactgtgacctactatgacccgcctgttaaagatagcgtattatccaaattacaccatagtaaccaatacaggtttctagacaaagcggcggtgataatagaaggcgatctaacatccgagggagttccggcgaacaagtggcgattatgcagcattcaagaagtggaagaagtgaagtgtttgattcgaatcgttcctgtttggtcggccggaataatatcactcgcggcgatgacacaacaaggaactttcactgtctctcaagctttaaaaatggaccgacatataggccccaacttcgagattccggccggttctctctcagtcatctctctcctcaccatcggcgtttttcttcccttatacgaccgcgttttagtcccattcttccgtcggatcaccagccataaatccggtatcacactcctccaacgtatcgggacagggatcgttttcgctatcctctccatgatcgttgccgggttagtggagcgcatgagacgaatgcgctccattaacgcaggagatccgaccgggatgacccccatgtcggtgttttggctctcgccgcagcttattctgatgggactatgcgaagcattcaatatcattggacagattgagttcttcaacagtcagtttcctgaacacatgagaagcatcgctaactctctcttctctttatccttcgccggttcgaactaccttagtagtttgattgtgacgacggttcataaattctccggtggccatgaccgtcctgattggcttaacaagaatctcaacgcgggaaaattggattacttctattatctgatagcggttctgggtgtgttcaatctggtttacttttggtactgtgctcagggataccggtacaaggttggtttacagatgggaggtttcgaggaggacaagagtttctctgatgttgagatgagttccaaaaaacagctgaaatgatttaaagcaacaagaagatgatcgatgttgttttaatgattacgatgacaatgtatctaagtataatatataattcag

SEQ ID NO: 2437 - protein, 594 aa, Brassica napus
  misc_feature (97)..(504): Pfam Name: PTR2 Pfam Description: POT family
  misc_feature (1)..(594): Ceres Clone ID no. 1381517
  misc_feature (1)..(594): Bit score of 1220.3 for HMM based on sequences of Figure 38
  misc_feature (1)..(594): Functional Homolog Of SEQ ID NO. 2425
MDVSDSHSQKSSPHSILDAEKVEKKPGGWRAVTFILGNETLERLGTIGLLSNFMVYLTRVFHLEQVDASNVINIWSGFSNLTPLVGAFISDAYVGRFKTIAFASFATLLGLVTLTLTASLPQLHPETCNSKDPVSCGGPNKLQFGILLLGLGFLSIGSGGIRPCSIPFGVDQFDQRTEEGIKGVASFFNWYYMTFTVVLIITQTVVVYIQDQVSWIIGFSVPTGLMACAVVMFFAGMKLYVYVKPEGSIFSGIAQVVVAARKKRKMKLPAEDDGTVTYYDPPVKDSVLSKLHHSNQYRFLDKAAVIIEGDLTSEGVPANKWRLCSIQEVEEVKCLIRIVPVWSAGIISLAAMTQQGTFTVSQALKMDRHIGPNFEIPAGSLSVISLLTIGVFLPLYDRVLVPFFRRITSHKSGITLLQRIGTGIVFAILSMIVAGLVERMRRMRSINAGDPTGMTPMSVFWLSPQLILMGLCEAFNIIGQIEFFNSQFPEHMRSIANSLFSLSFAGSNYLSSLIVTTVHKFSGGHDRPDWLNKNLNAGKLDYFYYLIAVLGVFNLVYFWYCAQGYRYKVGLQMGGFEEDKSFSDVEMSSKKQLK

SEQ ID NO: 2438 - protein, 644 aa, Arabidopsis thaliana
  misc_feature (161)..(554): Pfam Name: PTR2 Pfam Description: POT family
  misc_feature (1)..(644): Public GI ID no. 12325237
  misc_feature (1)..(644): Bit score of 1184.3 for HMM based on sequences of Figure 38
  misc_feature (1)..(644): Functional Homolog Of SEQ ID NO. 2425
MVLEDRKDGSSLPGRSGSFSKSSPSELDVVDPYKRISSPGSILDAEKVEKKPGGWRAVSFILGNETLERLGSIGLLANFMVYLTKVFHLEQVDAANVINIWSGFTNLTPLVGAYISDTYVGRFKTIAFASFATLLLLNYFCIVRKRMNLLRDHAIEDDKGLITITLTASFPQLHPASCNSQDPLSCGGPNKLQIGVLLLGLCFLSVGSGGIRPCSIPFGVDQFDQRTEEGVKGVASFFNWYYMTFTVVLIITQTVVVYIQDQVSWIIGFSIPTGLMALAVVMFFAGMKRYVYVKPEGSIFSGIAQVIVAARKKRKLKLPAEDDGTVTYYDPAIKSSVLSKLHRSNQFRCLDKAAVVIEGDLTPEGPPADKWRLCSVQEVEEVKCLIRIVPIWSAGIISLAAMTTQGTFTVSQALKMDRNLGPKFEIPAGSLSVISLLTIGIFLPFYDRVFVPFMRRITGHKSGITLLQRIGTGIVFAIFSMIVAGIVERMRRIRSINAGDPTGMTPMSVFWLSPQLILMGLCEAFNIIGQIEFFNSQFPEHMRSIANSLFSLSFAGSSYLSSFLVTVVHKFSGGHDRPDWLNKNLNAGKLDYFYYLIAVLGVVNLVYFWYCARGYRYKVGLPIEDFEEDKSSDDVEMTSKKSMK

SEQ ID NO: 2439 - protein, 576 aa, Arabidopsis thaliana
  misc_feature (86)..(484): Pfam Name: PTR2 Pfam Description: POT family
  misc_feature (1)..(576): Public GI ID no. 186478915
  misc_feature (1)..(576): Bit score of 1043.0 for HMM based on sequences of Figure 38
  misc_feature (1)..(576): Functional Homolog Of SEQ ID NO. 2425
MGVVENRKILPEKKLGGWRAITFILGNETLEKLGSIGVSANFMLYLRNVFHMEPVEAFNVYYLWMGLTNFAPLLGALISDAYIGRFKTIAYASLFSILGLMTVTLTACLPQLHPPPCNNPHPDECDDPNKLQLGILFLGLGFLSIGSGGIRPCSIPFGVDQFDQRTEQGLKGVASFFNWYYLTLTMVLIFSHTVVVYLQTVSWVIGFSIPTSLMACAVVLFFVGMRFYVYVKPEGSVFSGIARVIVAARKKRDLKISLVDDGTEEYYEPPVKPGVLSKLPLTDQFKFLDKAAVILDGDLTSEGVPANKWRLCSIQEVEEVKCLIRVVPVWSAGIISIVAMTTQATFMVFQATKMDRHMGPHFEIPAASITVISYITIGIWVPIYEHLLVPFLWRMRKFRVTLLQRMGIGIVFAILSMFTAGFVEGVRRTRATEMTQMSVFWLALPLILMGLCESFNFIGLIEFFNSQFPEHMRSIANSLFPLSFAAANYLSSLLVTTVHKVSGTKDHPDWLNKDLDRGKLDYFYYLIAVLGVVNLVYFWYCAHRYQYKAGSQIEDFNEEKSLLDIEPNQRHDQSPS

SEQ ID NO: 2440 - protein, 573 aa, Oryza sativa subsp. indica
  misc_feature (92)..(487): Pfam Name: PTR2 Pfam Description: POT family
  misc_feature (1)..(573): Public GI ID no. 125537558
  misc_feature (1)..(573): Bit score of 1464.4 for HMM based on sequences of Figure 38
  misc_feature (1)..(573): Functional Homolog Of SEQ ID NO. 2425
MEKQQQPGGEEEEEVISSVRYRGWKSMPYVIGNETFEKLGTIGTTANLLVYLTTVYHLPSVRAATLLNFFSGTTNLAPLLGAFLSDTFLGRYTTIAAASLASCLGMLVLTLTAAIPSLHPPPCTASSSSSSCQGPTHGQLAALLAAFAFLVVGAGGIRPCNLAFGADQFDPRTDSGRRGIASFFNWYYFTFTVAMMLSATLIIYLQSNVSWAIGLAVPAALMAISCALFFMGTRLYVRVRPEGSPFTSFARVIVAAVRKRRVPAPASADDLFDPPHQSKLVAKIAYTDQFRCLDKAAVVTPESRSSPWRLCTVQQVEEVKCLARIIPVWSAGIVYFIVVTQLGTFVVLQALQMDRRLTRWWAFEVPAGSMVVFNMMAMTVWIPVYDRVVVPALRRVTGKEGGISQLQRIGVGLVLSVATMVVAAAVEQRRRRLGAVGVKMSFLWLVPQQVAAGMSEAFAAIGQTELYYRQFPENMRSVAGALFFLAFALANYASGFMVAAVHRTTGWLAQDLNHARLDLFYLTVAAIAAANVCYFLLCARWYRFKNTTIADHVELPDYHHHQPGTANTIGSKV

SEQ ID NO: 2441 - DNA, 2159 bp, Panicum virgatum
  misc_feature (1)..(2159): Ceres Clone ID no. 1863500
  misc_feature (1)..(2159): Encodes the peptide sequence at SEQ ID NO. 2442
gacttgggaacagcgctggcttttttgctccgtccagccactggtgtgtagcaaggctagctcagacatggctgcccaagaggagggagcgcaggcgacgcagatcgaggccgtgaggaagaagaagccgcaagggtggaagtgcatgcccttcatcatagcaaacgagacgttcgaaaaggcagcctcattcggagtggcagcgaacctgacaacgtaccttgtgaagcgcttcaacatcgggcaactccaggcgaccaacgtaaccaacatcttcttcgccacgctcaacttcacaccattgctaggcgccttcatctccgattcctacctgggaaggttcagaaccctagcctatgggtgcttcgcgaccctcctggggatactgggggtgactttgacttcgtcacttcctgccctcaaaccagagatatgcaatcaaacagcccaattaggtggacactgcaatggtccatcaacactgcagctgggagtgctatacctttcactagggctgctaactattggtggtggagcaatacggccctgcagcttacctttcggagtagaccaatttgatcagactgatgaaaagagtcgaaagggcctaaatagctattataattggtactatagcacaagtactgctgctctggtgttctctatgactgttctcatctacatccagacaaatgtcagctgggcaataggatttggcatacccacattgttcatgtttttcgcaattatcatcttcttcgccggtgccagattttatgtccatgtaccaccagaggggagcatcttatctggatttgcgcaagtttttgtggcatcatttaaaaagagaagactcaatcttccatgttctcatgacataagcaaacaagagttgatgctctacaaccctcccacaaggggcagccgcattttcagactgccacttacttcacaattcaggtttctgaacaaaggtgcaattatgctggatggtgatataaacgatgatggttctgcaagaaactcatgggaactctgcagtatccagcaaatagaggaagccaaatgtttgataagacttgtgcctatttctttttctggcatcctatgtttcgttgcaatggctcaacaattcacctttatagtattgcaagcgttcaccatggactgtcacctagggccacactttgaaattcctgcaggttctgtttcatccatctcacttattgccctaaccgtgttcatccccatttacgaccaacttatggtaccacttgcaagaaagttgactgggctggaaggtggaattacagtcctacagagacagggtgtaggattggcactttctccaatttctatggtggtagcaggacttattgagcataaaaggagggattcagctttgtctaatggaggtatatcatctatgacagtttggtggcttgcaccccaactggttttaatgggtattgctgaggccttcaatgcagttggacaaatagaattctacaataagcagtttccagagcatatgcaaaccctagcaggatcccttttgttctgtactattgctggagcaagctacatgagcactgcgctggtaagcatcacaacaaaggttagcggcagaaatggtaacacaggctggttaacagaaaatatcaacgatggcaaacttgattattactattattttattgccatcctgggagtgctgaatcttttctacttccttgtatgctctcactattatcaatataaggtcgtgtcattccatgctgaagaatccatcaaaacacatgtcaaggaagaagcagctacagagatagagatcgtcacaagtgcaccaagcaaatgaaaatttcaatggcgatctataatatgcagacttagtgacaattaaggttcagtttgtaagatgccttatagtaacatattatcttatgaagaagtgaactacggttcagccagccatggtgactctgttatccaaacaacagtaaataaaggtctattattttggaacttcattaagttttaacgaagtctgtcatacttcagtagaagctaatatcgcctgtaatatgtgtaacatgtaagcacaggcagagtacaccaatttcttcacagattttactgcagtttgtatgtagaagtct

SEQ ID NO: 2442 - protein, 596 aa, Panicum virgatum
  misc_feature (92)..(501): Pfam Name: PTR2 Pfam Description: POT family
  misc_feature (1)..(596): Ceres Clone ID no. 1863500
  misc_feature (1)..(596): Bit score of 975.0 for HMM based on sequences of Figure 38
  misc_feature (1)..(596): Functional Homolog Of SEQ ID NO. 2425
MAAQEEGAQATQIEAVRKKKPQGWKCMPFIIANETFEKAASFGVAANLTTYLVKRFNIGQLQATNVTNIFFATLNFTPLLGAFISDSYLGRFRTLAYGCFATLLGILGVTLTSSLPALKPEICNQTAQLGGHCNGPSTLQLGVLYLSLGLLTIGGGAIRPCSLPFGVDQFDQTDEKSRKGLNSYYNWYYSTSTAALVFSMTVLIYIQTNVSWAIGFGIPTLFMFFAIIIFFAGARFYVHVPPEGSILSGFAQVFVASFKKRRLNLPCSHDISKQELMLYNPPTRGSRIFRLPLTSQFRFLNKGAIMLDGDINDDGSARNSWELCSIQQIEEAKCLIRLVPISFSGILCFVAMAQQFTFIVLQAFTMDCHLGPHFEIPAGSVSSISLIALTVFIPIYDQLMVPLARKLTGLEGGITVLQRQGVGLALSPISMVVAGLIEHKRRDSALSNGGISSMTVWWLAPQLVLMGIAEAFNAVGQIEFYNKQFPEHMQTLAGSLLFCTIAGASYMSTALVSITTKVSGRNGNTGWLTENINDGKLDYYYYFIAILGVLNLFYFLVCSHYYQYKVVSFHAEESIKTHVKEEAATEIEIVTSAPSK

SEQ ID NO: 2443 - DNA, 1761 bp, Populus balsamifera subsp. trichocarpa
  misc_feature (1)..(1761): Ceres Annot ID no. 1468256
  misc_feature (1)..(1761): Encodes the peptide sequence at SEQ ID NO. 2444
atggatagcatgatggagcagcctgcagatgagcatcgtgagaactacagaggagtaaaagccatgccttttgttataggaaatgagacatttgagaagctggggagtacaggaaccttgtccaacttactggtctatcttactaccgttttccacatgaaaagcattacagctacaactcttataaatatcttcaatggtaccaccaatattgctacattattaggagccttcctctgtgacacttactttggtcgttacaagacactggcatttgcttccatagcctcttttctggggatggtggtaataacactaacagctgcaatctcaaagctacacccaccccaatgtgcaagtggaacacaagatactgctgcatgccctgcactaacgccatggcaaatgacttttctattaagtggcctgggactacttgtaattggaggtggcggcattaggccatgtaacttggcttttggtgccgaccaatttaatccccaaaccgaatcaggaaggaagggaatcaccagcttttttaattggtactacttcaccttcacttttgccatgatgatatccttgacaatcgtagtgtatgtacagtcagatatcaactgggcttgggggctagcaatccctgcatttttgatgttcttttcatgtgtgctcttcttcgctggttcaaggatttatgtcaaagttaaaccagatggaagccccttaacaagcgtggtgcaggtaatagtggctgcaatcaagaagaggaaactcgagctaccggagcaaccatggctctccctttttaaccatatcccagcccgttccatcaactccaaccttccctatactgatcaattcagatttctcgacaaagctgcaatcttgaccactgaagaccaaattatgtcaaatgggtcaacagccactccatggagactttgcagcttgcaacaagtagaggaagtaaaatgcttgttgcgagtgattcccatatgggcttcagctctcttatattatattggtctaattcagcagcaaacctatgtagtcttccaggcccttcaatccaatagaggccttggcaatactaatttcaagattccagcagcttcgtatgctatcttctccatgcttggtctaaccatttggatacctatatacgatcgcctaatagttccatggctcgccaagcacaccaagaaagaaggtgggatcacaatcctccaaaagatgggtgttggcatggctctaggcatagtcacaatgcttatatctggcatagtggaagagagaagaagagctttggcaatcagtagcccgataggggtagactcgagaagtaatgtcaatgtatcctctctgtcagcattgtggttggcacctcagctgatactcataggaatttctgaggcatttacaattatagcacaaatcgagttgtattacaagcaattcccagaaaacatgagaagcatcggtgggtctttatcgtttgttggtgttgcagtatctagttacctcagtgcattcttgatatccatggttcaccaaataactaaaaagagtgcttgtggggattggttgcctgaagatcttaacaagggaagattggacctcttctattacctggttgctgctctcggagtcataaatatgggctactttatagtttgtgcaaagtggtacaagtacaaaggaaatgatggtactagcaatactcttgaaattggcgaaaacctcatgtttaaaagaaattag

SEQ ID NO: 2444 - protein, 586 aa, Populus balsamifera subsp. trichocarpa
  misc_feature (87)..(502): Pfam Name: PTR2 Pfam Description: POT family
  misc_feature (1)..(586): Ceres Annot ID no. 1468256
  misc_feature (1)..(586): Bit score of 1043.4 for HMM based on sequences of Figure 38
  misc_feature (1)..(586): Functional Homolog Of SEQ ID NO. 2425
MDSMMEQPADEHRENYRGVKAMPFVIGNETFEKLGSTGTLSNLLVYLTTVFHMKSITATTLINIFNGTTNIATLLGAFLCDTYFGRYKTLAFASIASFLGMVVITLTAAISKLHPPQCASGTQDTAACPALTPWQMTFLLSGLGLLVIGGGGIRPCNLAFGADQFNPQTESGRKGITSFFNWYYFTFTFAMMISLTIVVYVQSDINWAWGLAIPAFLMFFSCVLFFAGSRIYVKVKPDGSPLTSVVQVIVAAIKKRKLELPEQPWLSLFNHIPARSINSNLPYTDQFRFLDKAAILTTEDQIMSNGSTATPWRLCSLQQVEEVKCLLRVIPIWASALLYYIGLIQQQTYVVFQALQSNRGLGNTNFKIPAASYAIFSMLGLTIWIPIYDRLIVPWLAKHTKKEGGITILQKMGVGMALGIVTMLISGIVEERRRALAISSPIGVDSRSNVNVSSLSALWLAPQLILIGISEAFTIIAQIELYYKQFPENMRSIGGSLSFVGVAVSSYLSAFLISMVHQITKKSACGDWLPEDLNKGRLDLFYYLVAALGVINMGYFIVCAKWYKYKGNDGTSNTLEIGENLMFKRN

SEQ ID NO: 2445 - protein, 586 aa, Vitis vinifera
  misc_feature (88)..(501): Pfam Name: PTR2 Pfam Description: POT family
  misc_feature (1)..(586): Public GI ID no. 225456647
  misc_feature (1)..(586): Bit score of 1074.4 for HMM based on sequences of Figure 38
  misc_feature (1)..(586): Functional Homolog Of SEQ ID NO. 2425
MENNEKVVATDEPKTKHRGIKAMPFVIGNETFEKLGTIGTSTNLLVYLTTVFNMKSITATTFVNVFNGSTNFATLIGAFLCDTYFGRYTTLGFASISSFLGMLVITLTAAVQKMHPPHCGTTDTGTCIGPTAGQMAFLLSGFGLLVIGAAGIRPCNLAFGADQFNPETESGKRGISSFFNWYYFTYTFAMMVSLTVIVYVQSDVSWSLGLAIPTLLMLLSCALFFMGTRIYVKVKPEGSPLKNVAQVIVAAVKKRRLELPGQPWLSLFNHIPANSINSKLPHTDQFRFLSKGAILTPEVQINSDGSAANPWRLSSMQKVEEVKCVIRVIPIWAAGIIYYVALVQQSTYVVFQALQSDRRLGSTGFKIPAASYTVFTMLSLTIWIPIYDQIIVPLLRRLTGKEVGITLLQKMGIGMVLAVITMILSALVEERRRTLALTKATVGIEARRGAISSLSGMWLVPQLTLIGISEGLTIIGQVEFFYKQFPENMRSFAGAFLFCGIAFSNYLSSFLVSIVHQSTGGTATGNWLPEDLNKGRLDYFYYLVAALGMVNLLYFLACAKWYKYKDSEESPLEVSLEKMQPQKPLV

SEQ ID NO: 2446 - DNA, 2080 bp, Triticum aestivum
  misc_feature (1)..(2080): Ceres Clone ID no. 792606
  misc_feature (1)..(2080): Encodes the peptide sequence at SEQ ID NO. 2447
acaagcgccaccacaccatctacctacctatgtgcgccggctgctaccttggtgcttgcgtagtgttcagcgagcaagagatcgatggacgcgcctcggcagcagcaggaggaggagcgcaaggagaagacgaaggcggtgaaggccgtctccgaggaggccgggtcgtcgtcctcggacaccggcgacgatggcgaggaggaggcgggcgccgtccacaaccaccgcggatggaaggccatgccctacgtcatagggaacgagacgttcgagaagctcgggacgatcggcacgctgtcaaacatgctggtgtacctgacaacggtgtaccacatgccgagcgtcaacgccgccaccctcctcaatgtattctccggcaccagcaacctcgccactgtcttcggcgcctacgtgagcgacacctacctcggccgctacaccaccatcgccgccgccaccatgtcctccttcataggcatgctcatcctcacgctcacggccgctatccacaccctccatcctcccgcgtgcaacgcgtccaaggggcaacattgtgagggtcccactggctcccagctcgccgccatcctagtgtccttcttcttcctagtcatcggtgctggaggcatccggccctgcaaccttgcctttggggccgaccagttcaacccacacactgctgatggtcgccgcggcatcgccagcttcttcaactggtactacttcaccttcacagtcgccatgatgctctcggcaaccgtcatcatctacctccagagcaacgttaattgggcgctagggctcgcagtgcctgccgcgctcatgggcctctcatgtgccgtcttcttcatgggcacacgcctctatgtccgtgtacgccccgagggcagccccttcacaagcttcgcccaagtcctcgtcgccgccgcccgcaagcgccacatccggcgagctcgcggcgatgccgagctgtttgacccaccgcaccagagtaagctcgtctccaagctggcatacaccgaccagtttgcgtgccttgataaggcggccgtgcggacccctgacgacgcgttgtgcatcgacgggaagacaccggctgacccgtggcggttgtgcacggtgcaacaggtggaggaggtcaagtgcctagcgcgcatcattccggtgtggtcgtcggggatcgtctacttcatcgtgctcacccagctgggcacctatgtcgtgctccaggctgcgcagatggaccgccgaatcagcaagtccagcagcttccagatcccgcaaggctccttcgtcgtcttccagatgctcgccctcacgatgtggatccctgtctacgaccgattcgtggtgccggcccttcgccgcttcacaaagcgcgagggcggcatcaccctgctccaacggatcggtgtcgggttggcgttgtctgtggcgacaatggtggtgtcagcggctgtggagcagcgacgacgaaagatcggctcgtcgatgtcgtgcttctggctggtgccgcagcaactgctggcgggcctgtcggaggcgttcggcgccatcgggcagattgagttctactaccggcagttcccggagaacatgcggagcgtggcgggggcgctctacttcctggggttcgcgatggcgagctacgcaagcgggctgatggtgatggtggtgcaccgggcgacgcgcgggcggggcggtcagcctgactggctggcgcaggacctggacgagggtagggtggacctgttctacctggtcaccgccgccatcgccactgtgaacctcgtctactttgtgatctgtgcacggtggtacaggttcaagaagtccgacgatgccggtgccggagatgttgagctcgacgacgacagcccgaagaaggctagtgctggtttagcttagttattattgcctccttttggggcttaatatactccgatgcatgcataggatggtagagtctaatggatatatgtgcatatgtacgtatgctcatcgatcgatcccggggaatgtatgtaatacagatttggaactaatcaaaaagccgaacaagggagattgaatagcagct

SEQ ID NO: 2447 - protein, 607 aa, Triticum aestivum
  misc_feature (118)..(517): Pfam Name: PTR2 Pfam Description: POT family
  misc_feature (1)..(607): Ceres Clone ID no. 792606
  misc_feature (1)..(607): Bit score of 1199.3 for HMM based on sequences of Figure 38
  misc_feature (1)..(607): Functional Homolog Of SEQ ID NO. 2425
MDAPRQQQEEERKEKTKAVKAVSEEAGSSSSDTGDDGEEEAGAVHNHRGWKAMPYVIGNETFEKLGTIGTLSNMLVYLTTVYHMPSVNAATLLNVFSGTSNLATVFGAYVSDTYLGRYTTIAAATMSSFIGMLILTLTAAIHTLHPPACNASKGQHCEGPTGSQLAAILVSFFFLVIGAGGIRPCNLAFGADQFNPHTADGRRGIASFFNWYYFTFTVAMMLSATVIIYLQSNVNWALGLAVPAALMGLSCAVFFMGTRLYVRVRPEGSPFTSFAQVLVAAARKRHIRRARGDAELFDPPHQSKLVSKLAYTDQFACLDKAAVRTPDDALCIDGKTPADPWRLCTVQQVEEVKCLARIIPVWSSGIVYFIVLTQLGTYVVLQAAQMDRRISKSSSFQIPQGSFVVFQMLALTMWIPVYDRFVVPALRRFTKREGGITLLQRIGVGLALSVATMVVSAAVEQRRRKIGSSMSCFWLVPQQLLAGLSEAFGAIGQIEFYYRQFPENMRSVAGALYFLGFAMASYASGLMVMVVHRATRGRGGQPDWLAQDLDEGRVDLFYLVTAAIATVNLVYFVICARWYRFKKSDDAGAGDVELDDDSPKKASAGLA

SEQ ID NO: 2448 - DNA, 1947 bp, Zea mays
  misc_feature (1)..(1947): Ceres Clone ID no. 1576419
  misc_feature (1)..(1947): Encodes the peptide sequence at SEQ ID NO. 2449
attactgacaggcgccagagagagagagagagagaccacaactcctctcgcctcgcctcgcctcgcctcccccggggaagaagaggaggagagggagctgagcagcagccggccgacgcgggaatgctcgtcggcggcgggcgggacgacgaggaggtgctccggaagctcaagagcatggacgtggacaagatggagaacggcggcggcggcggtgaggcggagagcccgcgccccgccgtcaagtaccacggctggaaggccatgcccttcatcatcgggaacgagacgttcgagaagctggggacgctgggcacgtcggccaacctgctggtgtacctgacgcaggtgttccacatgcggagcgtggacgcggccacgctgctcaacgggctcaacggcaccaccagcctcgcccccatcgtcggcgccttcctctccgacgcctacctcggccgctacctcgcgctcgccatcgcctccatcgcctccctcatcggcatgttcctgctgacgcttacggccggcgcggacagccttcacccgccggagtgcagcgtgggggagacctgcgagaaggcaacgtcgtaccagttcgcggtgctcttcgtcgccttcgcgttcctggtgctgggctcggcggggatccgcccctgcagcatgcccttcggcgccgaccagttcgacccccacacggagtccggcaagcgcggcatcaacagcttcttcaactggtactacttcacgttcacggcggccatgatgatctccgccaccgtcatcatctacgtgcagagcagcgtgagctggcccatcgggctgggcatccccacggcgctcatgttcctggcctgcgtgctcttcttcatgggcacgcgcctctacgtgcgggtgacgcccgaggggagccccttcaccagcgtcgtgcaggtgctgtcggccgcgctcaagaagcggtcgctgaagcagcccaaggacccgaagcaggacctcttcgacccgccgcacaccagcgccatcgtcacccagctcgcgcacacggaccagttccgctgcctcgacaaggcggccatcgtggcgtcccaggacgagttgcgccccggcggcgccgcgcccgcggacccctggaggctctgcagcgtgcagcaggtggaggaggtcaagtgcctcatccgcatcgtgcccgtctggtccacggggatcatctactacgtcgccgtggtgcagcagtccacgtacgtggtgctctcggcgctgcagtccgaccgccacctcggcggcgccggcttccagatccccgccgcgtccttcaccgtcttcgccatgctcgcgcagacgctgtggatcccgttctacgaccgcctcctgctgcccaagctccggaagataaccggcaaggaagaggggttcacgctgctccagcgccagggcatcggcatcgcgctctccaccgtcgccatggtcatctctgccatcgtcgaggaccggcgccgtgccatcgcgctcagccagccgacactcggaaccaccatcaccggcggggccatctcggccatgtccagcctgtggatggtgccgcagctcatgatcctgggcctatcggaggcattcaacctcatcagccagattgagttctactacaaggagatcccggagcacatgcggagcgtggcgggggcgctcgcattctgcaacctggcgctcggcaactacctcagcggcttcctggtgaccatcgtgcaccggaccacggggtccgggcagaactggctggcgcaggacctcaacaagggccgcctcgacctcttctactggaccatcgcaggcatcggcgtctttaatctcatctactttgtcatctgcgccaggtggtacaggttcaaggggaccagcaactgatccgccaggttcatggttggacaggttggtggggttggataattatgt

SEQ ID NO: 2449 - protein, 591 aa, Zea mays
  misc_feature (113)..(525): Pfam Name: PTR2 Pfam Description: POT family
  misc_feature (1)..(591): Ceres Clone ID no. 1576419
  misc_feature (1)..(591): Bit score of 1513.4 for HMM based on sequences of Figure 38
  misc_feature (1)..(591): Functional Homolog Of SEQ ID NO. 2425
MLVGGGRDDEEVLRKLKSMDVDKMENGGGGGEAESPRPAVKYHGWKAMPFIIGNETFEKLGTLGTSANLLVYLTQVFHMRSVDAATLLNGLNGTTSLAPIVGAFLSDAYLGRYLALAIASIASLIGMFLLTLTAGADSLHPPECSVGETCEKATSYQFAVLFVAFAFLVLGSAGIRPCSMPFGADQFDPHTESGKRGINSFFNWYYFTFTAAMMISATVIIYVQSSVSWPIGLGIPTALMFLACVLFFMGTRLYVRVTPEGSPFTSVVQVLSAALKKRSLKQPKDPKQDLFDPPHTSAIVTQLAHTDQFRCLDKAAIVASQDELRPGGAAPADPWRLCSVQQVEEVKCLIRIVPVWSTGIIYYVAVVQQSTYVVLSALQSDRHLGGAGFQIPAASFTVFAMLAQTLWIPFYDRLLLPKLRKITGKEEGFTLLQRQGIGIALSTVAMVISAIVEDRRRAIALSQPTLGTTITGGAISAMSSLWMVPQLMILGLSEAFNLISQIEFYYKEIPEHMRSVAGALAFCNLALGNYLSGFLVTIVHRTTGSGQNWLAQDLNKGRLDLFYWTIAGIGVFNLIYFVICARWYRFKGTSN

SEQ ID NO: 2450 - DNA, 1794 bp, Sorghum bicolor
  misc_feature (1)..(1794): Ceres Annot ID no. 8723986
  misc_feature (1)..(1794): Encodes the peptide sequence at SEQ ID NO. 2451
atggcgcagcagcacgacaaggcatccacattcgccgccgcccaggagatggcgaccaccaccaagacgaagcagcagctctccgatgatgaatccgacgccggcgagccagaggagaactaccgcggatggaagtccatgccctacgtcatagggaacgagacgtgcgagaagctgggcaccatcggcacgacggccaacctgctggtgtacctcaccaccgtctacggcatgaccggcgccagcgccgccaccttgctcaacctctggtcgggcaccgtcagcatggcgccgctcctgggcgccttcctcagcgactcctacctgggccgctacaccaccatcgccttcgcctccgtcgcctccttcctcggcatgatcatcctcaccctcaccgccgccgtgccgtccctccaccccaacgaccccaccgccggcgccccccaccccaataacggaccctcgtcgctccagatggccgtgctcctcgcctccttcgccctcctcgccgtcggcgccggcggcatccgcccctgcaacctggccttcggcgccgaccagttcgacccgcgcaccccggcgggtcgacggggcatcaacagcttcttcaactggtactacttcaccttcaccatcgccatgatgatctccgccaccgtcatcatctacctccagagcgacgtcaactgggcgctggggctcgccgtccccgccacgctcatgggcgtctcctgcgtcctcttcttcatgggcacgcgcctctacgtccgcgtccgccccgacggcagccccttcaccagcttcgctcaggtcctcgtcgccgccgcccgcaaccgccgtctccccgcgccgccttcccccgccgacgacctctacgacccgccgcaccggagcagcctcgtctccaagatcgcctacactcaccagttcctctgcctcgacaaggccgccgtgcgcaccagcaccacctccgacgaccaccacccgtggcgcctctgcacgctgcagcaggtggaggaggtcaagtgcctggcgcggctgctccccgtctggtcctccggcatcgtctactacatcgtgctcaccaacctcggcaactacaacgtgctccaggccatgcagacggaccgccacgtcgtcgccggcggcagcttccagatccccgcgggctccttcgtcgtcttcaacatgctggcgctcacgctctggctccctttctacgacggcgtgctcgtgccggcgatgcagcgcgtcaccaagcgcgagggcggcatcacccagctgcagcggatcggcgtcgggatcgtgctctccatcgtcaccatgctcgtcgccgccgccgtcgagagacaccgccgcagggtcggcgacgccacctcctgcttcctgctcgtgccgcagcagatgctggccggactctccgaggcgttcgccatcatcggacaggtcgagttctactacaagcagttcccggagaacatgcgcagcgtcgcgggggcgctgctgtccctgggcttcgccatagccagctacgccagcgggctcatggtcagcgtcgtgcaccggaccaccggcggcggccgcgacggacgccccgactggctggcgcaggacctcaaccagggacgcgtcgacctctactacctgctcatcgccgccatggcggccgtcaacctcgtctacttcgtcgtctgcgcgcgctggtacaggttcaagaagccggcggcagccgcccacgccgacgccgacgtggagctggagctggaggggaaggccgcagcgcctcctgtctga

SEQ ID NO: 2451 - protein, 597 aa, Sorghum bicolor
  misc_feature (112)..(506): Pfam Name: PTR2 Pfam Description: POT family
  misc_feature (1)..(597): Ceres Annot ID no. 8723986
  misc_feature (1)..(597): Bit score of 1154.3 for HMM based on sequences of Figure 38
  misc_feature (1)..(597): Functional Homolog Of SEQ ID NO. 2425
MAQQHDKASTFAAAQEMATTTKTKQQLSDDESDAGEPEENYRGWKSMPYVIGNETCEKLGTIGTTANLLVYLTTVYGMTGASAATLLNLWSGTVSMAPLLGAFLSDSYLGRYTTIAFASVASFLGMIILTLTAAVPSLHPNDPTAGAPHPNNGPSSLQMAVLLASFALLAVGAGGIRPCNLAFGADQFDPRTPAGRRGINSFFNWYYFTFTIAMMISATVIIYLQSDVNWALGLAVPATLMGVSCVLFFMGTRLYVRVRPDGSPFTSFAQVLVAAARNRRLPAPPSPADDLYDPPHRSSLVSKIAYTHQFLCLDKAAVRTSTTSDDHHPWRLCTLQQVEEVKCLARLLPVWSSGIVYYIVLTNLGNYNVLQAMQTDRHVVAGGSFQIPAGSFVVFNMLALTLWLPFYDGVLVPAMQRVTKREGGITQLQRIGVGIVLSIVTMLVAAAVERHRRRVGDATSCFLLVPQQMLAGLSEAFAIIGQVEFYYKQFPENMRSVAGALLSLGFAIASYASGLMVSVVHRTTGGGRDGRPDWLAQDLNQGRVDLYYLLIAAMAAVNLVYFVVCARWYRFKKPAAAAHADADVELELEGKAAAPPV

SEQ ID NO: 2452 - DNA, 1746 bp, Populus balsamifera subsp. trichocarpa
  misc_feature (1)..(1746): Ceres Annot ID no. 1521620
  misc_feature (1)..(1746): Encodes the peptide sequence at SEQ ID NO. 2453
atgggaaacagtggagaagatgagacaaatagcaagcctaaggttatctacagaggatggaaggtcatgccctttattatagggaacgaaacgttcgagaagctaggaaccattggaaccttgtccaacctcttgatatatctcactactgtcttcaacatgaagagcattacagctgcaactatcatcaccgtcttcaatggtactgccaacttgggcacattgatcggagcctttttgtgcgacacctactttggtcgctataagacgataggattcgctaccgtcgcctcctttctgggattgcttgctatacaactaacagcagcaatctcaaaactgcatccaccccactgtgcaaaggagagcatcacatgcatagggccaacaggcggtcaaatagcatttctactggcaggattcatcctgatgataataggagctggtggtatcaggccatgcaatttggcatttggagcagaccaattcgaccctgaaacagaatctggaaagaggggtgtaaatagtttcttcaattggtacttctttactttcacctttgcccaaatgatatccttaacgctaattgtctacgtgcaatccaatgttagctggcctataggtttaggaatcccagcaatcctgatgctcatttcttgtctagtatactacatgggtacaaaattgtacgtaaaagtgaaagccactggcagtccgatgaccagtgtagcacgggttatagttgttgcagtcaagaaaaggaagttgaagccagtggaccaaccttggctctcccttttcaactatattcctcccaagtccatcaattccaagctttcttacacggatcaattcagattcctcgacaaagcagcaatcatgactcaccaagatcaagtaaacccagatggatcgccagctaatccttggaaactttgtagtttgcagcaagtggaagaagtgaaatgcttgtttagggtgattcctgtatggacagctgctattatatactatgttgctgtggttcaacagcacacctatgtagtcttccaagctgttcagagtaacagacgccttggaaacagcaactttgcgataccagctgcatcatatattgtgttcttgatgctaagtatgagcatcttcattcctatctatgaccggattcttgtcccttttctgcggagaattacaggaaaagaagctggaatcacaattcttcaaagaattggcgttggcatatttctcacaattgttaccatgttagtctctggcttagttgaagagaagcgaaggactatagctcttaccaagccaactctaggaaacgcaccaagaaaaggtgccatttcatcaatgtcagctttatggttaatccctcagctatcactctcaggaattgcagaggcatttggttccattggccaggttgaattctactacaagcagtttcctgagaatatgagaagcattggagggtctctcttttattgcggcatggcagcttcaagttattttagtagtttactgataacagtagttcaccaaacaacaaatggtgcagcaactggaaattggttatcagaagatctcaacaagggaagactggattactactactacatgattgctgctttgggggtcctaaacatgggctattttttgctgtgtgccaggtggtacaagtacaaagggggcaaggatgatgcactgcttgaactctgtgggggagaaaaaacaatatga

SEQ ID NO: 2453 - protein, 581 aa, Populus balsamifera subsp. trichocarpa
  misc_feature (88)..(500): Pfam Name: PTR2 Pfam Description: POT family
  misc_feature (1)..(581): Ceres Annot ID no. 1521620
  misc_feature (1)..(581): Bit score of 1052.3 for HMM based on sequences of Figure 38
  misc_feature (1)..(581): Functional Homolog Of SEQ ID NO. 2425
MGNSGEDETNSKPKVIYRGWKVMPFIIGNETFEKLGTIGTLSNLLIYLTTVFNMKSITAATIITVFNGTANLGTLIGAFLCDTYFGRYKTIGFATVASFLGLLAIQLTAAISKLHPPHCAKESITCIGPTGGQIAFLLAGFILMIIGAGGIRPCNLAFGADQFDPETESGKRGVNSFFNWYFFTFTFAQMISLTLIVYVQSNVSWPIGLGIPAILMLISCLVYYMGTKLYVKVKATGSPMTSVARVIVVAVKKRKLKPVDQPWLSLFNYIPPKSINSKLSYTDQFRFLDKAAIMTHQDQVNPDGSPANPWKLCSLQQVEEVKCLFRVIPVWTAAIIYYVAVVQQHTYVVFQAVQSNRRLGNSNFAIPAASYIVFLMLSMSIFIPIYDRILVPFLRRITGKEAGITILQRIGVGIFLTIVTMLVSGLVEEKRRTIALTKPTLGNAPRKGAISSMSALWLIPQLSLSGIAEAFGSIGQVEFYYKQFPENMRSIGGSLFYCGMAASSYFSSLLITVVHQTTNGAATGNWLSEDLNKGRLDYYYYMIAALGVLNMGYFLLCARWYKYKGGKDDALLELCGGEKTI

SEQ ID NO: 2454 - DNA, 1979 bp, Zea mays
  misc_feature (1)..(1979): Ceres Clone ID no. 1570203
  misc_feature (1)..(1979): Encodes the peptide sequence at SEQ ID NO. 2455
gcaagagagccaatctggcttccgcccttaactccatcaacaccgtgtatgcggatgtgtataacactgtgtagatatggagtctcctgtagatagagcacgccagacccatccatcctcgtcgcttatttatacggccgacccgaatcaatatggaaggagcggccgaccataagcggcaggtggacgacaagccgccgtacgccgccgtggacgacaccatgaccaccaccacgaagaagatggtggaggagcagctctcagacgacgccggcggcggcggcgagctgccagagcagaactaccgtggatggaaggccatgccctacgtcatagggaacgagacgtgcgagaagctgggcaccatcggcaccacggccaacctgctggtgtacctcaccaccgtgtacggcatgtcgggcgccagcgccgccaccctgctcagcctctggtcgggcaccgtcaacctggcgccgctcctgggcgccttcctcagcgacacctacatgggccgctacgccaccatcgccttcgcctccatggcctccttcctcggcatgatcgtcctcaccctcaccgccgccgtgccgtcgctccaccctgccgccaacagcagcaccaccggcggcccctcgtccctccagatggccgtgctcctcgcctccttcgcgctgctggccgtcggcgccggcggcatccggccctgcaacctggccttcggcgccgaccagttcgacccgcgcaccccagccggccgccggggcatcaacagcttcttcaactggtactacttcaccttcaccatcgccatgatggtctccgccaccgtcatcatctacctccagagcgacgtcagctgggcgctggggctggccgtgccggccacgctcatgggcctctcctgcgcgctcttcttcatgggcacgcgcctctacgtccgcgtcccgcccgagggcagccccttcaccagcttcgcgcaggtgctcgtcgccgccgcgcgcaagcgacgcctgcccgcgccccgcgccgacctctacgacccgccgcaccggagcagcctcatctccaagatcgcgtacaccgaccagttcctgtgcctcgacaaggcggccgtgcgcacccctgaggacggccccgcccccaacccctggcgcctctgcacgctgcagcaggtggaggaggtcaagtgcctggcgcgcctgctccccgtctggtcctccggcatcgtctactacatcgtgctcaccaacctcggcaactacaacgtgctccaggccatgcagaccgaccgccgcgtcggccgcgggggcttccacatccccgcgggctccttcgtcgtcttcaacatgctggcgctcaccctctggctccccttctacgacggcgtgctcgtgccggccatgcagcgcctcaccgggcgcgagggcggcatcacccagctgcagcggatcggcacggggatcgtcctctccatcgtcaccatgctcgtcgccgccgccgtcgagcgccaccgccgcaggctcggcgactccgcctcctgcttcctgctcgtgccgcagcagatgctggccggcctgtccgaggccttcggcatcatcggacaggtcgacttctactacaaacagttcccggagaacatgcgcagcgtcgcgggggccatgctcttcctggcattcgccatcgccagctacgccagcggcctcatggtcagcgtcgtgcaccggaccaccggaggccccgacggccgccccgactggctggcgcaggacctcaaccagggccacgtcgacctctactacctgctcatagccgccatggcggcggtcaacctagtctacttcgtcgcctgcgcgcgctggtacaggttcaagaacccggccgccgccgacgtcgagcagctggagctggagttagagggaaaggccgcagcgcctcctgtctgaatactgaagagctattttcttttcttcctcctcatc

SEQ ID NO: 2455 - protein, 596 aa, Zea mays
  misc_feature (122)..(508): Pfam Name: PTR2 Pfam Description: POT family
  misc_feature (1)..(596): Ceres Clone ID no. 1570203
  misc_feature (1)..(596): Bit score of 1137.5 for HMM based on sequences of Figure 38
  misc_feature (1)..(596): Functional Homolog Of SEQ ID NO. 2425
MEGAADHKRQVDDKPPYAAVDDTMTTTTKKMVEEQLSDDAGGGGELPEQNYRGWKAMPYVIGNETCEKLGTIGTTANLLVYLTTVYGMSGASAATLLSLWSGTVNLAPLLGAFLSDTYMGRYATIAFASMASFLGMIVLTLTAAVPSLHPAANSSTTGGPSSLQMAVLLASFALLAVGAGGIRPCNLAFGADQFDPRTPAGRRGINSFFNWYYFTFTIAMMVSATVIIYLQSDVSWALGLAVPATLMGLSCALFFMGTRLYVRVPPEGSPFTSFAQVLVAAARKRRLPAPRADLYDPPHRSSLISKIAYTDQFLCLDKAAVRTPEDGPAPNPWRLCTLQQVEEVKCLARLLPVWSSGIVYYIVLTNLGNYNVLQAMQTDRRVGRGGFHIPAGSFVVFNMLALTLWLPFYDGVLVPAMQRLTGREGGITQLQRIGTGIVLSIVTMLVAAAVERHRRRLGDSASCFLLVPQQMLAGLSEAFGIIGQVDFYYKQFPENMRSVAGAMLFLAFAIASYASGLMVSVVHRTTGGPDGRPDWLAQDLNQGHVDLYYLLIAAMAAVNLVYFVACARWYRFKNPAAADVEQLELELEGKAAAPPV

SEQ ID NO: 2456 - DNA, 1791 bp, Populus balsamifera subsp. trichocarpa
  misc_feature (1)..(1791): Ceres Annot ID no. 1440475
  misc_feature (1)..(1791): Encodes the peptide sequence at SEQ ID NO. 2457
atgggggatgaggaaaagcaggcgcctgcaacccttgagatctccatggagaacggaaatttaaaggaggagaaaaccacttcaaatgatgagccagagattaaatacggaggaattaaagccatgccctttgtcataggaaatgagacctttgagaagcttggtacagttggctcttcaacaaatcttgctgtgtatctgactacagttttcaacatgaagagtgtcaaagccaccacacttcttaatgtctttaatggcacttcaaacctggcacctctgattggagcttacctctctgatacttactttggacgttactggaccttgggttttgcttctgtcttttctttcttggggatggtggtattgatgctaacagcagcaatctccaccatgcaccctccaaagtgcgccccaggtgctgtgtgtgctgggccaacaagctggcaactagccttcttattaagtgggtttgcttttttggtaatcggagctggtggcatcaggccttgcaacctagccttcggagctgatcaattcaatcccaacactgaatctggcaagaggggtatcactagcttcttcaattggtactactttaccttcactttcgcggtgatgatctcggtaactggcattgtctatgtgcaatcaaatgttagctgggccattggtttggggattcctgcatttctaatgctcctttcatgtgtaatgttcttcgtgggaacgagaatttatgttatagtgaaacctcaaggcagccccataactagtatagtacaagtacttgttgctgctaccaagaaacgaggcctcaaggttcctgataattcagctatgtctcttttcaactatattccagccaaatctatcaactctaagcttcctagcacagaacaatttaggtgtcttgacaaagctgcaatcattacagatgaaaatcagattaacttggatggtacagctgccaacccatggaaactttgtagcgtccaacaagttgaggaggtgaaatgcttgttgaggataatccccgtatggtcaacatccatactttatcaaattcccttgctccagcaacagacttacgcagtgttccaagcccttcagatggatagacgtctaggcagtaccagtttcaaggtgcccgccgcaacatatataatctttacaatgttaaccctcaccatttggattcccctctacgaccgaatcatcgttccatttcttcaaaggcttaccggcaaagacggtgggataacattgcttcaaagaatggggattggaatgattctagcgattctttgtacggttgtttctggattggtggaagaaaatagaaggcacattgctttaacaaggccaccgttaggccagacgaacaaaggtggctctatatcatcaatgtctggtatgtggctgataccacaacttgcactttctggactctctgagggtttcaattatattgcacagattgaattctactataagcaattcccagaaaatatgaggagtattgccggatccgccttcttcgcgggtggcgctctcgctaattatctcagtggtgtccttgtttctatagtccaccaaattacttcagggagtaaaactggagattggttggatgatgatcttaacaaagggaaattggattacttctattacgtgattgctggtttggggatcctcaactttggatattttcttttgtgtgccaaatggtatagatacaaagatgcagatgatagcacagtggggatggctacaaaaggaatctga

SEQ ID NO: 2457 - protein, 581 aa, Populus balsamifera subsp. trichocarpa
  misc_feature (92)..(503): Pfam Name: PTR2 Pfam Description: POT family
  misc_feature (1)..(581): Ceres Annot ID no. 1440475
  misc_feature (1)..(581): Bit score of 1108.3 for HMM based on sequences of Figure 38
  misc_feature (1)..(581): Functional Homolog Of SEQ ID NO. 2425
MENGNLKEEKTTSNDEPEIKYGGIKAMPFVIGNETFEKLGTVGSSTNLAVYLTTVFNMKSVKATTLLNVFNGTSNLAPLIGAYLSDTYFGRYWTLGFASVFSFLGMVVLMLTAAISTMHPPKCAPGAVCAGPTSWQLAFLLSGFAFLVIGAGGIRPCNLAFGADQFNPNTESGKRGITSFFNWYYFTFTFAVMISVTGIVYVQSNVSWAIGLGIPAFLMLLSCVMFFVGTRIYVIVKPQGSPITSIVQVLVAATKKRGLKVPDNSAMSLFNYIPAKSINSKLPSTEQFRCLDKAAIITDENQINLDGTAANPWKLCSVQQVEEVKCLLRIIPVWSTSILYQIPLLQQQTYAVFQALQMDRRLGSTSFKVPAATYIIFTMLTLTIWIPLYDRIIVPFLQRLTGKDGGITLLQRMGIGMILAILCTVVSGLVEENRRHIALTRPPLGQTNKGGSISSMSGMWLIPQLALSGLSEGFNYIAQIEFYYKQFPENMRSIAGSAFFAGGALANYLSGVLVSIVHQITSGSKTGDWLDDDLNKGKLDYFYYVIAGLGILNFGYFLLCAKWYRYKDADDSTVGMATKGI

SEQ ID NO: 2458 - DNA, 1956 bp, Sorghum bicolor
  misc_feature (1)..(1956): Ceres Annot ID no. 8644892
  misc_feature (1)..(1956): Encodes the peptide sequence at SEQ ID NO. 2459
atggcgcgcccctccgtccccggcaccggtgaacaccccgcggcgcccgccggcggcgacaccattctcgcggtcgtccacgatgacggcacaggccatcacgactcgttggacgccgccgggcgggaggtccggtaccgggggtggaaggcgatgccgttcgtgatcgggaacgagacgttcgagaagcttggcagcatcggcaccgcggcgaacctgatggtgtacctcacctccgtcttccacatgaccaacctccgcgccgccgtggcgctcaacgtcttcggcggcaccaccaacctcgccaccgtcttcggcgccttcgcctccgacctctgcctcggccgctacgccaccgttggcttcggctgcgtcgcgacactcatcggcatgatcatcctgacgctgacggccggcgtgccggcgctgcacccgccgccgtgcagcgccgtcgcgggcgggcagcagtgcgcgggcgcgaccaagggacagctcgcggtgctggcgctgtccttcttgttcatcgtggtgggcgccggcggcatccggccgtgcagcctgccgttcggcgccgaccagttcgacccgaacacggagtccggccgccgcgggatcaacagcttcttcaactggtactacttcaccctgaccatcgccgtcgtgggctcgtcgacggggatcatctacgtgcagagcaacgtgagctggtgcatcgggttcgccatccccaccgcgctcatgttcgcctcctgcgtgctcttcttcgccggcgccgggctctacgtccgcgtgcgccccgagggggggatccccttggccagcgtcttccgcgtcgccgtcgcggcggcccgcaagcgccgcgccccggctcctcaggaccccgcggcgtccctcttccggacgcgccacgcgagctcgctcgtgtcgaggctcccctacaccgaccagttcaggttcctcgacaaggccgccgtggtggagtccgacagcgaggtcgtcgacgactccagcggcggcggcggcggcaagcccagggacccgtggcggctgtgcagcctgcagcaggtggaggaggccaagtgcgtcctccgcatcatgccggtgtgggccacctgcatcgtctactacgtggcgttcgcgcagaccaacacctacgtcgtcctgcaggcggcgcagtccgaccgccgcctcggccccggcggcttcgaggctccgccggcgtcgttcaccatcttccctatgctggcgctcgcggtgtggatcccgttctacgaccggctcgtggtgccgtggctgcgcgggctcaccggcgtcgagggcggcatgacgctgctccagcgcatgggcgtgggcatggcgctctccgtcgtggccatgatcgtcgccggcgtcgtggagcagcgcaggcgcgagctcgccgtgctccaccaggcggaggcgaaccgcgacctgctctcggtgaccctcgtctcgccggcgtcggcgttctggctggtgccgcagctggcggcgctgggcctctcggaggcgttcaaccaggtgagccagatggagttctactacaagcagttcccggagaacatgcgcagcgtcgccgggtcgctgatcttcaccggcctggcgatgtccatgtacctcagcgggctgctggtcgtcgtggtgcaccgcgcgacggccgaccccgtgctcggcgacgacgggtggctcgccgagaacctcaacagggggaagctggactggttctacttcctcatcgccttcatcggtgccgtcaacttcttcgtgttcctcgcatgcgcgaaatggtacaggtacaagggactggatgatggtggacgaggaggtgcagacgacgacggggtccatgtccatgtccatcaatggcagccaacaacagtgcaagtagtggacgactgtcctgaggaaggaagagtagtacgtagacgtagtttctga

SEQ ID NO: 2459 - protein, 651 aa, Sorghum bicolor
  misc_feature (117)..(540): Pfam Name: PTR2 Pfam Description: POT family
  misc_feature (1)..(651): Ceres Annot ID no. 8644892
  misc_feature (1)..(651): Bit score of 1028.1 for HMM based on sequences of Figure 38
  misc_feature (1)..(651): Functional Homolog Of SEQ ID NO. 2425
MARPSVPGTGEHPAAPAGGDTILAVVHDDGTGHHDSLDAAGREVRYRGWKAMPFVIGNETFEKLGSIGTAANLMVYLTSVFHMTNLRAAVALNVFGGTTNLATVFGAFASDLCLGRYATVGFGCVATLIGMIILTLTAGVPALHPPPCSAVAGGQQCAGATKGQLAVLALSFLFIVVGAGGIRPCSLPFGADQFDPNTESGRRGINSFFNWYYFTLTIAVVGSSTGIIYVQSNVSWCIGFAIPTALMFASCVLFFAGAGLYVRVRPEGGIPLASVFRVAVAAARKRRAPAPQDPAASLFRTRHASSLVSRLPYTDQFRFLDKAAVVESDSEVVDDSSGGGGGKPRDPWRLCSLQQVEEAKCVLRIMPVWATCIVYYVAFAQTNTYVVLQAAQSDRRLGPGGFEAPPASFTIFPMLALAVWIPFYDRLVVPWLRGLTGVEGGMTLLQRMGVGMALSVVAMIVAGVVEQRRRELAVLHQAEANRDLLSVTLVSPASAFWLVPQLAALGLSEAFNQVSQMEFYYKQFPENMRSVAGSLIFTGLAMSMYLSGLLVVVVHRATADPVLGDDGWLAENLNRGKLDWFYFLIAFIGAVNFFVFLACAKWYRYKGLDDGGRGGADDDGVHVHVHQWQPTTVQVVDDCPEEGRVVRRRSF

SEQ ID NO: 2460 - DNA, 1782 bp, Zea mays
  misc_feature (1)..(1782): Ceres Clone ID no. 1529998
  misc_feature (1)..(1782): Encodes the peptide sequence at SEQ ID NO. 2461
  misc_feature (1679)..(1679): n is a, c, t, g, unknown, or other
agctcgctcctcctcttcttctcctctttcttctcgaaccatcatcatatatatatagaatcaatatggaaggagcggccgaccataagcggcaggtggacgacaagccgccgtacgccgccgtggacgacaccatgaccaccaccacgaagaagatggtggaggagcagctctcagacgacgccggcggcggcggcgagctgccagagcagaactaccgtggatggaaggccatgccctacgtcatagggaacgagacgtgcgagaagctgggcaccatcggcaccacggccaacctgctggtgtacctcaccaccgtgtacggcatgtcgggcgccagcgccgccaccctgctcagcctctggtcgggcaccgtcaacctggcgccgctcctgggcgccttcctcagcgacacctacatgggccgctacgccaccatcgccttcgcctccatggcctccttcctcggcatgatcgtcctcaccctcaccgccgccgtgccgtcgctccaccctgccgccaacagcagcaccaccggcggcccctcgtccctccagatggccgtgctcctcgcctccttcgcgctgctggccgtcggcgccggcggcatccggccctgcaacctggccttcggcgccgaccagttcgacccgcgcaccccagccggccgccggggcatcaacagcttcttcaactggtactacttcaccttcaccatcgccatgatggtctccgccaccgtcatcatctacctccagagcgacgtcagctgggcgctggggctggccgtgccggccacgctcatgggcctctcctgcgcgctcttcttcatgggcacgcgcctctacgtccgcgtcccgcccgagggcagccccttcaccagcttcgcgcaggtgctcgtcgccgccgcgcgcaagcgacgcctgcccgcgccccgcgccgacctctacgacccgccgcaccggagcagcctcatctccaagatcgcgtacaccgaccagttcctgtgcctcgacaaggcggccgtgcgcacccctgaggacggccccgcccccaacccctggcgcctctgcacgctgcagcaggtggaggaggtcaagtgcctggcgcgcctgctccccgtctggtcctccggcatcgtctactacatcgtgctcaccaacctcggcaactacaacgtgctccaggccatgcagaccgaccgccgcgtcggccgcgggggcttccacatccccgcgggctccttcgtcgtcttcaacatgctggcgctcaccctctggctccccttctacgacggcgtgctcgtgccggccatgcagcgcctcaccgggcgcgagggcggcatcacccagctgcagcggatcggcacggggatcgtcctctccatcgtcaccatgctcgtcgccgccgccgtcgagcgccaccgccgcaggctcggcgactccgcctcctgcttcctgctcgtgccgcagcagatgctggccggcctgtccgaggccttcggcatcatcggacaggtcgacttctactacaaacagttcccggagaacatgcgcagcgtcgcgggggccatgctcttcctggcattcgccatcgccagctacgccagcggcctcatggtcagcgtcgtgcaccggaccaccggaggccccgacggccgccccgactggctggcgcangacctcaaccagggccacgtcgacctctactacctgctcatagccgccatggcggcggtcaacctagtctacttcgtcgcctgcgcgcgctggtacaggttca

SEQ ID NO: 2461 - protein, 572 aa, Zea mays
  misc_feature (122)..(508): Pfam Name: PTR2 Pfam Description: POT family
  misc_feature (1)..(572): Ceres Clone ID no. 1529998
  misc_feature (1)..(572): Bit score of 1097.0 for HMM based on sequences of Figure 38
  misc_feature (1)..(572): Functional Homolog Of SEQ ID NO. 2425
  misc_feature (538)..(538): Xaa is any aa, unknown, or other
MEGAADHKRQVDDKPPYAAVDDTMTTTTKKMVEEQLSDDAGGGGELPEQNYRGWKAMPYVIGNETCEKLGTIGTTANLLVYLTTVYGMSGASAATLLSLWSGTVNLAPLLGAFLSDTYMGRYATIAFASMASFLGMIVLTLTAAVPSLHPAANSSTTGGPSSLQMAVLLASFALLAVGAGGIRPCNLAFGADQFDPRTPAGRRGINSFFNWYYFTFTIAMMVSATVIIYLQSDVSWALGLAVPATLMGLSCALFFMGTRLYVRVPPEGSPFTSFAQVLVAAARKRRLPAPRADLYDPPHRSSLISKIAYTDQFLCLDKAAVRTPEDGPAPNPWRLCTLQQVEEVKCLARLLPVWSSGIVYYIVLTNLGNYNVLQAMQTDRRVGRGGFHIPAGSFVVFNMLALTLWLPFYDGVLVPAMQRLTGREGGITQLQRIGTGIVLSIVTMLVAAAVERHRRRLGDSASCFLLVPQQMLAGLSEAFGIIGQVDFYYKQFPENMRSVAGAMLFLAFAIASYASGLMVSVVHRTTGGPDGRPDWLAXDLNQGHVDLYYLLIAAMAAVNLVYFVACARWYRF

SEQ ID NO: 2462 - DNA, 2007 bp, Panicum virgatum
  misc_feature (1)..(2007): Ceres Clone ID no. 1823719
  misc_feature (1)..(2007): Encodes the peptide sequence at SEQ ID NO. 2463
atttataaggcgcggcggatgctcgatcgatctcctcctcaaagactcgctcctagatacaccggcgccaccaacagcacagctgctgcgctgcgtgcttgccatggaggccaataataatagtaagcacgggaaggcgtactccgtcgccgaggaagatgctacgactaccaataatatgatgatgaagcagaagcacctctccgacgacgaggccgccgccggcgagccggaggagaactaccgcgggtggaaggccatgccttacgtcatagggaacgagacgtgcgagaagcttggcaccatcggcaccacggccaacctgctggtctacctcaccaccgtctacggcatcaagagcgccagcgccgccacgctgctcagcctctggggcggcaccgtcaacctcgcccccgtcctcggcgccttcctcagcgactcgtacctcggccgctacgccaccatcgccctcgcctccatcgcctccttcgtcggcatgatcctcctcaccctcaccgccgccgtcccctcgctccacccgcacgccggcgcggggccctccgcctcccacatggccgtgctcctcgcctccttcgcgctgctcgccgtcggggccggcggcatccgcccctgcaacctcgccttcggcgccgaccagttcgacccccgcacgcccgccggccgccgcgggatcaacagcttcttcaactggtactacttcaccttcaccatcgccatgatggtctccgccacgttcatcatctacctccagagcaacgtcagctgggcgctcggcctcgccgtcccggccacgctcatgggcctctcctgcgcgctcttcttcatgggcacgcgcctctacgtccgcgtccgccccgagggaagccccttcaccagcttcgcccaggtcgtcgtcgccgcctaccgcaagcgccgcctgcaccgaggtccctgcgacctcttattcgacccgccgcaccggaggagcagcctcgtgtccaagatcgcctacacggaccagttcctgtgcctggacaaggccgccattctcaccgctgacgacgagctcgcggtcacggccgacggcaccacgccggcgaacccgtggcggctgtgcacggtgcagcaggtggaggaggtcaagtgcctggtgcggctgctcccggtgtggtcgtcggggatcgtctactacatcgtgctcaccaacctgggcaactacggcgtgctccaggccatgcagacggaccggcgcctcgggcggtcggggttccagatcccggcggggtccctggtggtgttcaacatgctggcgctcacggcgtggctccccgtgtacgacggcgtggtggtgccggcgctgcagcgggtgaccaagcgcgagggcggcatcacccagctgcagcggatgggcgccggcatcgtgctgtccatcgccaccatggtggcggcggcggcggtggagcggcaccggcgcgcggtgggggacgcgacgtcgtgcttcgtgctggtgccgcagcagatgctggcggggctgtcggaggcgttcgcggtgatcgggcaggtggaactgtactacaagcagttcccggagaacatgcgcagcgtggccggcgcgctgctgttcctgggcttcgccgtggccagctacgccagcgggctgatggtgacggtggtgcaccggacgacgggagggagcgacgggcggccggactggctgacgcaggacctcaaccaggggcgcgtcgacctctactatctggtgatcgcgggcatggccgccgtcaacctcgtctacttcgtggcgtgcgcgcgctggtacaggttcaaggagtcggcggaccacgccggcgccgtcgagctggaggagaaggacaaggtcgttgttgttactgatgcaggcgccgccgcacctccacctccagtatgaagctccgtaccgtacctctccgatgcttaaataatcggaaaagctaagttcgaaaattaaatgaagatgcagcgtcgatc

SEQ ID NO: 2463 - protein, 607 aa, Panicum virgatum
  misc_feature (118)..(510): Pfam Name: PTR2 Pfam Description: POT family
  misc_feature (1)..(607): Ceres Clone ID no. 1823719
  misc_feature (1)..(607): Bit score of 1134.0 for HMM based on sequences of Figure 38
  misc_feature (1)..(607): Functional Homolog Of SEQ ID NO. 2425
MEANNNSKHGKAYSVAEEDATTTNNMMMKQKHLSDDEAAAGEPEENYRGWKAMPYVIGNETCEKLGTIGTTANLLVYLTTVYGIKSASAATLLSLWGGTVNLAPVLGAFLSDSYLGRYATIALASIASFVGMILLTLTAAVPSLHPHAGAGPSASHMAVLLASFALLAVGAGGIRPCNLAFGADQFDPRTPAGRRGINSFFNWYYFTFTIAMMVSATFIIYLQSNVSWALGLAVPATLMGLSCALFFMGTRLYVRVRPEGSPFTSFAQVVVAAYRKRRLHRGPCDLLFDPPHRRSSLVSKIAYTDQFLCLDKAAILTADDELAVTADGTTPANPWRLCTVQQVEEVKCLVRLLPVWSSGIVYYIVLTNLGNYGVLQAMQTDRRLGRSGFQIPAGSLVVFNMLALTAWLPVYDGVVVPALQRVTKREGGITQLQRMGAGIVLSIATMVAAAAVERHRRAVGDATSCFVLVPQQMLAGLSEAFAVIGQVELYYKQFPENMRSVAGALLFLGFAVASYASGLMVTVVHRTTGGSDGRPDWLTQDLNQGRVDLYYLVIAGMAAVNLVYFVACARWYRFKESADHAGAVELEEKDKVVVVTDAGAAAPPPPV

SEQ ID NO: 2464 - protein, 588 aa, Oryza sativa subsp. japonica
  misc_feature (101)..(503): Pfam Name: PTR2 Pfam Description: POT family
  misc_feature (1)..(588): Public GI ID no. 115489780
  misc_feature (1)..(588): Bit score of 1136.4 for HMM based on sequences of Figure 38
  misc_feature (1)..(588): Functional Homolog Of SEQ ID NO. 2425
MPPAPSQEQTKLAPEKQQHISGHGEQAVRYHGWKVMPYVIGNETCERLGTIGTTANLLVYLTTVFHIPSAAAATLLNVFSGTSNLAPLLGAFLCDAYLGRYATLAAASIASFLGMLVLTLTAAIPSLHPPPCASSSSTSCQGPTHRQLAALLASFAFLVVGAGGIRPCNLAFGADQFDPATAAGRRGIASFFNWYYFTFTIAMMVSATLIIYLQSNINWAIGLAVPTALMALSCALFFMGTRLYVRVRPEGSPFTSFAQVLVAAARKRRLPAPASPADDLFDPPHRSKLVAKIKHTDQFRWLDKAAVVTAEDAVVDGMSAAAANPWRLCTVQQVEEVKVLARMIPVWSSSIVYYVMLTQLGTYTVFQVMQSDRRVGRSGFEVPAGSMVVFNMVALTAWLPVYDRAVVPALRRVTGREEGISQLQRIGIGLALSVATMAVAVAVEQRRRGAGGGSSSSWAWMVPQQAMAGLSEAFAAIGLNELCYKESPESMRSVAGALSPLALAVASYASGAMVTAVERATGWLAQDIDKGRVDLFYLVVGAMSAANLAYFVVCALWYRSKNIADHGGVELLQTSSKHNADAPPAMAV

SEQ ID NO: 2465 - protein, 605 aa, Glycine max
  misc_feature (102)..(515): Pfam Name: PTR2 Pfam Description: POT family
  misc_feature (1)..(605): Public GI ID no. 11933400
  misc_feature (1)..(605): Bit score of 982.2 for HMM based on sequences of Figure 38
  misc_feature (1)..(605): Functional Homolog Of SEQ ID NO. 2425
MTGVETMGKNENQSVEKNEKSVIDEEPKINYRGWKVMPFIIGNETFEKLGTIGTLANLLVYLTTVFNLSSLTATNIINIFTGSASLSTLLGAFLCDTYFGRYKTLGFCTIASFLGLLVIQLTAWIKKMHPPHCGSESITCTGPTTGQMTFLLAGFGLLIVGAAGIRPCNLAFGVDQFNPNTESGKKGINSFFNWYFFTYTFAQMVSLSLIVYIQSNVSWAIGLGIPAALMLISCTLYYTGSNYYVKVKATGPAPLTSLAQAVVVAIKKRRLNLSEYPLDSSLFAYVSPQSINSKLLHTSQFRFLDKAAIITPQDGINPDGSASDPWSLCSMQQVEELKCLLRVIPIWFAGIFFYIAIVQQNTMLVFQALQSDRRILSTNFKILAASYTIFQMLSLTIWLPIYDRILVPSLQRVTKKEGGITVLQRIGFGMFLSILCTMVSGVVEERRRTLALTNPIGLEPRKGAISSMSGLWLVPQLTLAGLSDAFAIVGQVEFFYKQFPENMKSLAASLFFCGLAGSSYLSSLLISIIHRATAKSSTGNWLPQDLNKGRLDYFYYIITALAVVNFGYFILCAKWYKYKGTGSSSSGDLQLDQVSKPSERTVNTV

SEQ ID NO: 2466 - protein, 587 aa, Oryza sativa subsp. japonica
  misc_feature (111)..(520): Pfam Name: PTR2 Pfam Description: POT family
  misc_feature (1)..(587): Public GI ID no. 115454673
  misc_feature (1)..(587): Bit score of 1405.8 for HMM based on sequences of Figure 38
  misc_feature (1)..(587): Functional Homolog Of SEQ ID NO. 2425
MRGGGGGGGGGGEEAGQKLKSMDVDKLENGGDKPALKYHGWRAMPFIIGNETFEKLGTLGTSANLLVYLTQVFHMRSVDAATLLNGLNGTTSLAPIIGAFLSDAYLGRYLALAIASVASLIGMFLLTMTAAADGLHPAECGVGETCSKATSGQFAVLFMSFAFLVLGSAGIRPCSMPFGADQFDPHTESGKRGINSFFNWYYFTFTSAMLVSATVIIYVQSNVSWPIGLGIPTALMLLACVLFFMGTRLYVRVTPEGSPFTSIVQVFAAAARKRSLKQPKDPKQDLFDPPHTSAIVTKLAHTDQFRCLDKAAIVSGPDDVRAGGAAPSNPWRLCSVQQVEEVKCLIRIVPVWSTGIIYYVAVVQQSTYVVLSALQSDRHLGRSFQIPAASFTVFAMLAQTLWIPIYDRLLVPRLRRVTGKDEGLTLLQRQGIGIALSTVAMVMSAVVEDRRRHIALTQPTLGTTITGGAISAMSSLWMVPQLMVLGLSEAFNLISQIEFYYKEIPEHMRSVAGALAFCNLALGNYLSGFLVTIVHRTTGAGSNWLAQDLNKGRLDLFYWMIAGIGIFNIIYFMICAKWYRFKGAAAN

SEQ ID NO: 2467 - protein, 597 aa, Glycine max
  misc_feature (94)..(507): Pfam Name: PTR2 Pfam Description: POT family
  misc_feature (1)..(597): Public GI ID no. 11933397
  misc_feature (1)..(597): Bit score of 967.8 for HMM based on sequences of Figure 38
  misc_feature (1)..(597): Functional Homolog Of SEQ ID NO. 2425
MTGVEAMEKNEKSVTDEEPKINYRGWKVMPFIIGNETFEKLGTIGTLANLLVYLTTVFNLSSLAATNIVNIFNGSASLSTLLGAFLCDTYFGRYKTLGFSTMASFLGLLVIQLTAWIKKMHPPHCGRDSITCIGPTTGQMGFLLAGFGLLIVGAAGIRPCNLAFGVDQFNPNTESGKKGINSFFNWYFFTFTFAQMVSLSLIVYIQSNVSWAIGLGIPAALMLISCTLYYTGSNYYVKVKATGPAPLTSLAQAVVVAIKKRRLNLSEYPLDSSLFAYVSPQSINSKLLHTSQFRFLDKAAIITPQDGINPDGSASDPWSLCSMQQVEELKCLLRVIPIWFAGIFFYIAIVQQNTMLVFQALQSDRRILSTNFKILAASYTIFQMLSLTIWLPIYDRILVPSLQRVTKKEGGITVLQRIGFGMFLSILCTMVSGVVEERRRTLALTNPIGLEPRKGAISSMSGLWLVPQLTLAGLSDAFAIVGQVEFFYKQFPENMKSLAASLFFCGLAGSSYLSSLLISIIHRATAKSSTGNWLPQDLNKGRLDRLYYIITALEVVNFGYFILCAKWYKYKGTGSSSSGDLQLDQVSKPSERTVNTV

SEQ ID NO: 2468 - protein, 587 aa, Arabidopsis thaliana
  misc_feature (91)..(502): Pfam Name: PTR2 Pfam Description: POT family
  misc_feature (1)..(587): Public GI ID no. 15221883
  misc_feature (1)..(587): Bit score of 923.3 for HMM based on sequences of Figure 38
  misc_feature (1)..(587): Functional Homolog Of SEQ ID NO. 2425
MEVEKTEKNIAEDDESKIIYRGWKVMPFIIGNETFEKLGIVGSSSNLVIYLTTVFNMKSITAAKVVNIYGGTSNFGTIVAAFLCDSYFGRYKTLSFAMIACFLGSVAMDLTAVIHPLHPAQCAKEIGSVCNGPSIGQIMFLAGAMVLLVIGAGGIRPCNLPFGADQFDPKTKEGKRGIESFFNWYFFTFTFAQMVSLTLIVYVQSNVSWSIGLAIPAILMLLGCIIFFAGSKLYVKVKASGSPIHSITRVIVVAIKKRRLKPVGPNELYNYIASDFKNSKLGHTEQFRFLDKSAIQTQDDKLNKDGSPVDAWKLCSMQQVEEVKCVIRVLPVWLSAALFYLAYIQQTTYTIFQSLQSDRRLGPGSFQIPAGSYTVFLMLGMTIFIPIYDRVLVPFLRKYTGRDGGITQLQRVGAGLFLCITSMMVSAIVEQYRRKVALTKPTLGLAPRKGAISSMSGMWLIPQLVLMGIADALAGVGQMEFYYKQFPENMRSFAGSLYYCGIGLASYLSTFLLSAVHDTTEGFSGGSWLPEDLNKGRLEYFYFLVAGMMTLNLAYFLLVSHWYRYKDVVAKDKDMDKTSAEFDKVSV

SEQ ID NO: 2469 - DNA, 1695 bp, Populus balsamifera subsp. trichocarpa
  misc_feature (1)..(1695): Ceres Annot ID no. 1493344
  misc_feature (1)..(1695): Encodes the peptide sequence at SEQ ID NO. 2470
atggagaacggaaatttaaaggaggagaaaaccacttcaaatgatgagccagagattaaatacggaggaattaaagccatgccctttgtcataggaaatgagacctttgagaagcttggtacagttggctcttcaacaaatcttgctgtgtatctgactacagttttcaacatgaagagtgtcaaagccaccacacttcttaatgtctttaatggcacttcaaacctggcacctctgattggagcttacctctctgatacttactttggacgttactggaccttggcagcaatctccaccatgcaccctccaaagtgcgccccaggtgctgtgtgtgctgggccaacaagctggcaactagccttcttattaagtgggtttgcttttttggtaatcggagctggtggcatcaggccttgcaacctagccttcggagctgatcaattcaatcccaacactgaatctggcaagaggggtatcactagcttcttcaattggtactactttaccttcactttcgcggtgatgatctcggtaactggcattgtctatgtgcaatcaaatgttagctgggccattggtttggggattcctgcatttctaatgctcctttcatgtgtaatgttcttcgtgggaacgagaatttatgttatagtgaaacctcaaggcagccccataactagtatagtacaagtacttgttgctgctaccaagaaacgaggcctcaaggttcctgataattcagctatgtctcttttcaactatattccagccaaatctatcaactctaagcttcctagcacagaacaatttaggtgtcttgacaaagctgcaatcattacagatgaaaatcagattaacttggatggtacagctgccaacccatggaaactttgtagcgtccaacaagttgaggaggtgaaatgcttgttgaggataatccccgtatggtcaacatccatactttatcaaattcccttgctccagcaacagacttacgcagtgttccaagcccttcagatggatagacgtctaggcagtaccagtttcaaggtgcccgccgcaacatatataatctttacaatgttaaccctcaccatttggattcccctctacgaccgaatcatcgttccatttcttcaaaggcttaccggcaaagacggtgggataacattgcttcaaagaatggggattggaatgattctagcgattctttgtacggttgtttctggattggtggaagaaaatagaaggcacattgctttaacaaggccaccgttaggccagacgaacaaaggtggctctatatcatcaatgtctggtatgtggctgataccacaacttgcactttctggactctctgagggtttcaattatattgcacagattgaattctactataagcaattcccagaaaatatgaggagtattgccggatccgccttcttcgcgggtggcgctctcgctaattatctcagtggtgtccttgtttctatagtccaccaaattacttcagggagtaaaactggagattggttggatgatgatcttaacaaagggaaattggattacttctattacgtgattgctggtttggggatcctcaactttggatattttcttttgtgtgccaaatggtatagatacaaagatgcagatgatagcacagtggggatggctacaaaaggaatctga

SEQ ID NO: 2470 - protein, 564 aa, Populus balsamifera subsp. trichocarpa
  misc_feature (92)..(486): Pfam Name: PTR2 Pfam Description: POT family
  misc_feature (1)..(564): Ceres Annot ID no. 1493344
  misc_feature (1)..(564): Bit score of 1047.1 for HMM based on sequences of Figure 38
  misc_feature (1)..(564): Functional Homolog Of SEQ ID NO. 2425
MENGNLKEEKTTSNDEPEIKYGGIKAMPFVIGNETFEKLGTVGSSTNLAVYLTTVFNMKSVKATTLLNVFNGTSNLAPLIGAYLSDTYFGRYWTLAAISTMHPPKCAPGAVCAGPTSWQLAFLLSGFAFLVIGAGGIRPCNLAFGADQFNPNTESGKRGITSFFNWYYFTFTFAVMISVTGIVYVQSNVSWAIGLGIPAFLMLLSCVMFFVGTRIYVIVKPQGSPITSIVQVLVAATKKRGLKVPDNSAMSLFNYIPAKSINSKLPSTEQFRCLDKAAIITDENQINLDGTAANPWKLCSVQQVEEVKCLLRIIPVWSTSILYQIPLLQQQTYAVFQALQMDRRLGSTSFKVPAATYIIFTMLTLTIWIPLYDRIIVPFLQRLTGKDGGITLLQRMGIGMILAILCTVVSGLVEENRRHIALTRPPLGQTNKGGSISSMSGMWLIPQLALSGLSEGFNYIAQIEFYYKQFPENMRSIAGSAFFAGGALANYLSGVLVSIVHQITSGSKTGDWLDDDLNKGKLDYFYYVIAGLGILNFGYFLLCAKWYRYKDADDSTVGMATKGI

SEQ ID NO: 2471 - DNA, 2078 bp, Arabidopsis thaliana
  misc_feature (1)..(2078): Ceres Annot ID no. 874402
  misc_feature (1)..(2078): Encodes the peptide sequence at SEQ ID NO. 2472
gaagagcagagtcattcttaaccatagagacagaagagataagaatcataacaacaacaacaccaatcattacacacaggttgatactatggagagaaagcctcttgaggttgagccatctactacgacgactaacaccgatgtggtcgattctttcgaggaagagcagagaaaaatcgtttatagaggatggaaagtcatgccttttatcattggtaatgagacatttgagaagcttgggatcatagggacattatcaaaccttcttgtgtacctaacttctgtattcaaccttaagagctacacagctgcaactatcatcaatgcctttagtggtacaatcaatttcgggacttttattgctgcctttctttgcgacacttactttggtcgctacaagactctcagtgtcgctgtcatcgcttgttttctgggatcgtttgtgatactacttactgctgcaattccgtcgttgcaccccgttgcttgcggaaacaaaatctcgtgcgaagggccaagtgtgggacagatactgtttctgctcatgggtttaggctttcttgtggtaggcgctggtggtatcagaccgtgtaatttagcgtttggtgctgatcagttcaaccccaaatccgaatcaggaaagaaagggatcaacagtttcttcaactggtatttcttcactttcacgttcgcgcagatcatctcgctcacagcagttgtgtatatccagtcaaatgtgagttggacaatcggtttgatcattccggtggctcttatgttcttggcgtgtgtgattttctttgctggcgatagattgtatgtaaaagtgaaagcctcgggtagtccattggctggtattgctcgtgttatagcagccgcgatcaagaaacgaggtttgaagccggttaagcagccttgggtcaatctttacaaccatatcccgtctaactatgcaaatactactctaaaatacaccgaccagttcagatttctagacaaagcagcaattatgacccccgaggagaagttgaactccgatggaacggcttccgatccatggaaactatgcacgttgcagcaagtggaagaagtgaaatgcattgtaagagtgattccaatctggtttgcatccacgatatactaccttgcaataactatacaaatgacttatccggtcttccaagcgctccagagcgaccgacgattaggttctggtggcttcaggattcctgcggccacctatgtagtgttcttgatgactggcatgacagttttcatcatattctacgaccgtgtacttgtcccgtcgctcagaagagtgaccgggttagaaaccggtatatcactcttacaaagaatcggagctgggtttacatttgcgataatgagtttattagtttccgggtttatagaggaaaggagaagaaactttgcattgaccaaaccgacactcgggatggcgcctcggacaggagaaatctcatcaatgtcagcgttgtggctgattccgcagcttacacttgcaggcatagcagaagcttttgctgccattggacaaatggagttttactacaagcagtttcctgaaaacatgaagagcttcgcgggttctatcttttatgtcggtgcaggggtttcgagctacctcgctagcttcttgatatcaactgttcatcgaacaaccgcgcattcaccttcagggaattggttagctgaggatctgaacaaagcgaaattggattacttctacttcatgctcacaggactcatggttgttaacatggcttacttcttgttgatggctagatggtatagatacaaaggaggtaatgatgaagacatcactgagattgagaccaatgaagaagaaaccaagcaacagcagctacaagacaagaactctgtctgatctggaaacttatatatttttggtattctacttcaatctccgtagtttttcttcacccgaaatcaaccttgttgtacttttatagattaattgaagaagaaaatcacttcatctttgtagacatgtattgtaaaataagttttttgttgctaatttcaacctccgtacg

SEQ ID NO: 2472 - protein, 606 aa, Arabidopsis thaliana
  misc_feature (103)..(514): Pfam Name: PTR2 Pfam Description: POT family
  misc_feature (1)..(606): Ceres Annot ID no. 874402
  misc_feature (1)..(606): Bit score of 924.3 for HMM based on sequences of Figure 38
  misc_feature (1)..(606): Functional Homolog Of SEQ ID NO. 2425
MERKPLEVEPSTTTTNTDVVDSFEEEQRKIVYRGWKVMPFIIGNETFEKLGIIGTLSNLLVYLTSVFNLKSYTAATIINAFSGTINFGTFIAAFLCDTYFGRYKTLSVAVIACFLGSFVILLTAAIPSLHPVACGNKISCEGPSVGQILFLLMGLGFLVVGAGGIRPCNLAFGADQFNPKSESGKKGINSFFNWYFFTFTFAQIISLTAVVYIQSNVSWTIGLIIPVALMFLACVIFFAGDRLYVKVKASGSPLAGIARVIAAAIKKRGLKPVKQPWVNLYNHIPSNYANTTLKYTDQFRFLDKAAIMTPEEKLNSDGTASDPWKLCTLQQVEEVKCIVRVIPIWFASTIYYLAITIQMTYPVFQALQSDRRLGSGGFRIPAATYVVFLMTGMTVFIIFYDRVLVPSLRRVTGLETGISLLQRIGAGFTFAIMSLLVSGFIEERRRNFALTKPTLGMAPRTGEISSMSALWLIPQLTLAGIAEAFAAIGQMEFYYKQFPENMKSFAGSIFYVGAGVSSYLASFLISTVHRTTAHSPSGNWLAEDLNKAKLDYFYFMLTGLMVVNMAYFLLMARWYRYKGGNDEDITEIETNEEETKQQQLQDKNSV

SEQ ID NO: 2473 - DNA, 1779 bp, Populus balsamifera subsp. trichocarpa
  misc_feature (1)..(1779): Ceres Annot ID no. 1475704
  misc_feature (1)..(1779): Encodes the peptide sequence at SEQ ID NO. 2474
atggagaatgtccttactaagacttcatcttcttcagctgatagtgatatcactcgagctcctcctaactctcttctccctcctaaaaaggaagctggaggatggagatctgtaaaatacattcttgggaacgagtcattcgagaaactggcttcaatgggtcttattgccaacttaacagtgtatctacaaacaagattcaacatggatggtattcagttggttaatgtgttcaatatttggtctggttccaccaatgttacacccttgcttggtgctttcttatctgatacatatctgggaaggttccgcactcttatctgcggttccacggcgtctttcctgggcatggtcgtcatgtccctaattgcaggcattccaaacttaagacccctccactgcactggaggatccaattgccaaaaacccgagttttggcagcttggagtcctctatttgggtcttggattgcttgccattggagctggaggtgttaggccttgcaacattgcctttggagctgatcaatttgacaccagaactgaaaagggaagagcccaactagagagcttcttcaactggtggtatttctctttcacggtgtctctggtgatagctctcactgtagtggtctacgttcagactaatgtgagttgggttataggttatggcatacctgcagcctgcttgttcttctctattgtcattttcttgattggaaaacacacttacataatcacaaagccgcaaggaagcgtttttgttgatatggccaaagtgatcgtagcagcctgtaagaagcgtgcaatgagtcttgaatcaactcctgaaaattccttctatgatcctccctggattgaatcagatcagcgtgtaacaaagcttgctcacacaaatatgttcaagttctttgacaaagctgccctaattgctgatccaagcgaattggatgacaaaggtttgcccaagaattcttggagattatgtagtgttcaacaagttgaacagctgaaactagtggtaggacttgtgccagtttggattactggaattggatgcttcattaccatggaccaaatgaatactttcggcttgatgcaagcaattcagtccaacaacaaaatccacaattttaaaatcccaccaggttggatgggccttagttcaatgatttgcctttcaacatggatattcatttacgagcaaatttacctgcctttcgcaaagaaaaggtcaaaaaagaatgttagattgacaatgagacagagaatcaacactggtattgtaatggcaatcctatgcatggtggtggctggaattgttgagaagaaccgccgggagacagctttgaaacagggatctttactgtcacctcaaagtattctactgctgctgccacagttttccttgtcgggtctgaacgaaggatttgctgctgttgctgttatggaatactataccaaccatttgccagagagcatgaggactcttgccggggccatcttctttctcagcttctctgcatccagctacctcaacacggttattgtcaatgtagtccaccatgtgactgctaaacttgggaaaacaccgtggttgggtggacgtgacctcaataaagttaaactcgacaacttctactaccttattgctggtttagcattattaaatcttctgtatttcaacctcttttcatgccgctatttggagaagaatgctgataaaagacctggatctaggcacgaggacaaggggttagagatgaatgaaaatgtttaa

SEQ ID NO: 2474 - protein, 592 aa, Populus balsamifera subsp. trichocarpa
  misc_feature (103)..(506): Pfam Name: PTR2 Pfam Description: POT family
  misc_feature (1)..(592): Ceres Annot ID no. 1475704
  misc_feature (1)..(592): Bit score of 734.5 for HMM based on sequences of Figure 38
  misc_feature (1)..(592): Functional Homolog Of SEQ ID NO. 2425
MENVLTKTSSSSADSDITRAPPNSLLPPKKEAGGWRSVKYILGNESFEKLASMGLIANLTVYLQTRFNMDGIQLVNVFNIWSGSTNVTPLLGAFLSDTYLGRFRTLICGSTASFLGMVVMSLIAGIPNLRPLHCTGGSNCQKPEFWQLGVLYLGLGLLAIGAGGVRPCNIAFGADQFDTRTEKGRAQLESFFNWWYFSFTVSLVIALTVVVYVQTNVSWVIGYGIPAACLFFSIVIFLIGKHTYIITKPQGSVFVDMAKVIVAACKKRAMSLESTPENSFYDPPWIESDQRVTKLAHTNMFKFFDKAALIADPSELDDKGLPKNSWRLCSVQQVEQLKLVVGLVPVWITGIGCFITMDQMNTFGLMQAIQSNNKIHNFKIPPGWMGLSSMICLSTWIFIYEQIYLPFAKKRSKKNVRLTMRQRINTGIVMAILCMVVAGIVEKNRRETALKQGSLLSPQSILLLLPQFSLSGLNEGFAAVAVMEYYTNHLPESMRTLAGAIFFLSFSASSYLNTVIVNVVHHVTAKLGKTPWLGGRDLNKVKLDNFYYLIAGLALLNLLYFNLFSCRYLEKNADKRPGSRHEDKGLEMNENV

SEQ ID NO: 2475 - DNA, 1959 bp, Sorghum bicolor
  misc_feature (1)..(1959): Ceres Annot ID no. 8703346
  misc_feature (1)..(1959): Encodes the peptide sequence at SEQ ID NO. 2476
atggcctcgcgccgtggaccaccggagccggagcaggaggctgcgggcggtggcggaggaggagcggaggcgacacggaggaggcccagtgggtggcgagccgtcgccttcatcatcggtctgtcgctagctgttttcatccacctccacgcatatgtcttcagcttcagtgcttcagcgatggcaacgggattaatgtgtgtgtgtgtgtgcgcgcgcgcgcttggaatggcatgggatgcaggggtctacgcggcagcttatatcgcgggcaacgccttctccttctccctcaccagctacctcatcgaccgttacaacatgaagcagaacgccgccacgaacgtgaacaacatcttctccggcacgttcaactttgcgcccgtcgtcggagccttcgtcgccgacgcgttctggggcaggttcaggaccctgctgtttggaaccgtggtcggagttgctgcaatggcggttatcactctatcggcgactatccatcagcttaaaccgccgccgtgcagcccggtggcacagcaagccgggacgtgtgtctccccgtcgggtctgcagcgagccgtgctctatctcggcatggggctgctcgtggtgtccgccggcggcatgaacccgactagcctgcccttcggcgcggaccagttcgacgagaggaaagagcagcacaagggagggctcacgcgcttctacaactggtactacgccgtcgccatgatagccacgttcctggcgctcaccgtcgtgctgtacgtccaggtcaacgtgagctggggcctcggcttcgccatccccacggcgcttatggccgtcgccttcgtggtgttcctcgtcggcaccaagatgtacgtctacgtgccgcccgagggcagcattttctcgagcgtcgcacgggtgttcgtcgcgtcgtgccgcaagtggaggctcccgctgccgcaccctgacgacgcgcggcgccaggaggagctcctgtacaacgctccgtccgccgtcgggaacgggcgccgcgtgttcaggctcccccttactctgcagctcagctttctaaacaaggcggccatcgtgaccgacgccgacgaggagatacggcccgacggctccccggcgaggccgtggaaactttgcagcgtgcagcaggtggaggaggccaagtgcctcctgaagatcatccccgtgtggatctccggcaccctgtggttcaccgtggtgacggagctgataaactacacgttcctccaggcgtcaaccatggacctccacatggggaagcacttcaccatcccgccggcgtcgatcgtcgccgtgctctacctctccgtcgcgctattcgtgcccgtctacgacctgctcatcgcccgcgccgcgcaccgggtcaccaaggcaggacgcggcatcaccttgctccagaggcagggcgccgggctggtggtcggcgcgctggcgttcgttgtcgcggccgccgtggagcgcaggcggaggcgctccgcggtggcacacggcgacggcatgtccccgctgtccgtgttcgtcctggcgccgcagctcgccgtgatgggcgtgtcgggcgcgttcagcatggtgggacagacggagttctacaacacgcagttcccagaccagatgcgcacgctcgccaacgcggcgttctactgcgcgcagggcatcagcagctacctggccacactcgtggtcaacatcgtgaacgcgaggacgaggcaacacggtgggtctgcgggatgggtcgccgacgacatcaacgccgggaggatcgactacttctactatgccatggcggtgctcactggagccaacttcgtctacttcctcgtgtgctcgcacttctaccagtacaagggcgagcaagccgctgacactcttggtggacatgaacctgcaacggacagtggtagcataagtgagagtgaagccgcactcctaaagacatag

SEQ ID NO: 2476 - protein, 652 aa, Sorghum bicolor
  misc_feature (142)..(557): Pfam Name: PTR2 Pfam Description: POT family
  misc_feature (1)..(652): Ceres Annot ID no. 8703346
  misc_feature (1)..(652): Bit score of 629.3 for HMM based on sequences of Figure 38
  misc_feature (1)..(652): Functional Homolog Of SEQ ID NO. 2425
MASRRGPPEPEQEAAGGGGGGAEATRRRPSGWRAVAFIIGLSLAVFIHLHAYVFSFSASAMATGLMCVCVCARALGMAWDAGVYAAAYIAGNAFSFSLTSYLIDRYNMKQNAATNVNNIFSGTFNFAPVVGAFVADAFWGRFRTLLFGTVVGVAAMAVITLSATIHQLKPPPCSPVAQQAGTCVSPSGLQRAVLYLGMGLLVVSAGGMNPTSLPFGADQFDERKEQHKGGLTRFYNWYYAVAMIATFLALTVVLYVQVNVSWGLGFAIPTALMAVAFVVFLVGTKMYVYVPPEGSIFSSVARVFVASCRKWRLPLPHPDDARRQEELLYNAPSAVGNGRRVFRLPLTLQLSFLNKAAIVTDADEEIRPDGSPARPWKLCSVQQVEEAKCLLKIIPVWISGTLWFTVVTELINYTFLQASTMDLHMGKHFTIPPASIVAVLYLSVALFVPVYDLLIARAAHRVTKAGRGITLLQRQGAGLVVGALAFVVAAAVERRRRRSAVAHGDGMSPLSVFVLAPQLAVMGVSGAFSMVGQTEFYNTQFPDQMRTLANAAFYCAQGISSYLATLVVNIVNARTRQHGGSAGWVADDINAGRIDYFYYAMAVLTGANFVYFLVCSHFYQYKGEQAADTLGGHEPATDSGSISESEAALLKT

SEQ ID NO: 2477 - DNA, 1719 bp, Populus balsamifera subsp. trichocarpa
  misc_feature (1)..(1719): Ceres Annot ID no. 1455393
  misc_feature (1)..(1719): Encodes the peptide sequence at SEQ ID NO. 2478
atggaaaactcaatagtagaggagaagatggttctcatccctaaggacaaggaccccagaaagggtggcctgaggaccatgcccttcatcatagttaatgaggcatttgagcgggtggctagctatgggctgatgccaaatatgatattctacttgatgaaaaactatcgcatggaggctgcaagtgggtcaaccattctcttcttgtggtctgctatgtctaatggattgtccattttcggagccttcctctccgattcattcatgggtcggtatctggtcatctctttgggatcattctgcagccttcttgggatgattcttctttggttaactgccatgatcccacaactaacccctccaccttgtgaccgatttactaatgtctgcagctcagctactgcaggccaactagctactttattctcctctttcggccttatatcaatcggagccggttgcataagaccttgctctattgcctttggggcagaccaactagacaataaagagaaccccaataatgagagtgtcttacagagtttctttaattggtattatgctgcgacaggattatcaacaattatagcatttactgctattgtctacgttcaagataacctcggttggaaagttggatttgctattcctgcagttctcatgttcttctctgctctaatgtttttggtgggttcttcccagtacgtaaaagtgaaggcctccacgagcttatttactgggtttgttcaggttttagttgcagcattcaggaacagaaagctcagtctatctcacagtagcattgaacagtattattaccacagtgatgattctgagttccagatccccacggttaatttaaggtgtttaaaccgagcttgtatcataacagaccctgatagggatgtaaatccggatgggtcagcttcaaatccatggagtctatgtacagttgatcaggtagagtcactgaaagctctgcttagagtcatccccatttggtctacaggcatcatgatgcaaatcaacttaaatcaaaactcatttgccaccctccaagcaaataccatggacaggcaaatctttaattttgaactcccagcaggatctctcaatgtgtttctggttctcactctcacaatctggctaaccttctatgaccgaattctgctaccattgttagcaaaattcactggcaagcaacgcggcgggcctagtcctacagttaggataggaattggtttgctaatcccaattgcagcaagggcaatgtcagcagtagtagaaaccataagaaggagaactgctattgaggaaggactagaagaccaaccagatggtgtagtgaacatgtcagtagtctggcttttgccaccaattatcctacttggattggctgaagcttttaattcaattggacagatagaattctactactctcagttccctaaaagcatgtctagcattgcggtggctattttcactttcggaactgccatggctgacatgatagggagtggtttggtggatgttgtggatagagttacatctagaggagggcaagagagctggttgtctagtaatcttaacaagggtcggttagatgattattactggctgattactgtcttgagtataatcaattttgtgtattttcttgtttgctgtcggacttatggacgcactaaggacgaaaaggaggagcgtctgctggagtag

SEQ ID NO: 2478 - protein, 572 aa, Populus balsamifera subsp. trichocarpa
  misc_feature (92)..(498): Pfam Name: PTR2 Pfam Description: POT family
  misc_feature (1)..(572): Ceres Annot ID no. 1455393
  misc_feature (1)..(572): Bit score of 571.8 for HMM based on sequences of Figure 38
  misc_feature (1)..(572): Functional Homolog Of SEQ ID NO. 2425
MENSIVEEKMVLIPKDKDPRKGGLRTMPFIIVNEAFERVASYGLMPNMIFYLMKNYRMEAASGSTILFLWSAMSNGLSIFGAFLSDSFMGRYLVISLGSFCSLLGMILLWLTAMIPQLTPPPCDRFTNVCSSATAGQLATLFSSFGLISIGAGCIRPCSIAFGADQLDNKENPNNESVLQSFFNWYYAATGLSTIIAFTAIVYVQDNLGWKVGFAIPAVLMFFSALMFLVGSSQYVKVKASTSLFTGFVQVLVAAFRNRKLSLSHSSIEQYYYHSDDSEFQIPTVNLRCLNRACIITDPDRDVNPDGSASNPWSLCTVDQVESLKALLRVIPIWSTGIMMQINLNQNSFATLQANTMDRQIFNFELPAGSLNVFLVLTLTIWLTFYDRILLPLLAKFTGKQRGGPSPTVRIGIGLLIPIAARAMSAVVETIRRRTAIEEGLEDQPDGVVNMSVVWLLPPIILLGLAEAFNSIGQIEFYYSQFPKSMSSIAVAIFTFGTAMADMIGSGLVDVVDRVTSRGGQESWLSSNLNKGRLDDYYWLITVLSIINFVYFLVCCRTYGRTKDEKEERLLE

SEQ ID NO: 2479 - protein, 559 aa, Arabidopsis thaliana
  misc_feature (89)..(490): Pfam Name: PTR2 Pfam Description: POT family
  misc_feature (1)..(559): Public GI ID no. 145358511
  misc_feature (1)..(559): Bit score of 595.4 for HMM based on sequences of Figure 38
  misc_feature (1)..(559): Functional Homolog Of SEQ ID NO. 2425
MDVESSSPSSHALIKKEKGGWRAIKYIIANESFEKLASMSLIGNLSVYLMTKYNLGGVFLVNVINIWFGSCNILTLAGAFVSDAYLGRFWTLLLGSIASFIGMGIFALTAALPSLRPDACIDPSNCSNQPAKWQLGVLFSGLGLLAIGAGGVRPCNIAFGADQFDTSTKKGKAHLETFFNWWYFSFTVALVIALTGVVYIQTNISWVIGFVIPTACLALSITTFVIGQHTYICAKAEGSVFADIVKVVTAACKKRKVKPGSDITFYIGPSNDGSPTTLVRDKHRLRFFDKASIVTNPNELNEDGNAKYKWRLCSVQQVKNLKCVTAILPVWVTGIACFILTDQQNIYGILQAMQMDKTFGPHNFQVPAGWMNLVSMITLAIWISLYECVIIPIVKQITGRKKRLTLKHRIEIVMGIICMIVAGFQEKKRRASALKNGSFVSPVSIVMLLPQFALAGLTEAFSAVALMEFLTVRMPEHMRAVAGAIFFLSSSIASYICTLLINVIDAVTRKEGKSWLGDKDLNKNRLENYFFIIAGIQVANLLYFRLFASRYATENKKGH

SEQ ID NO: 2480 - DNA, 1782 bp, Populus balsamifera subsp. trichocarpa
  misc_feature (1)..(1782): Ceres Annot ID no. 1492266
  misc_feature (1)..(1782): Encodes the peptide sequence at SEQ ID NO. 2481
atggaagagcccttgtcaagccaaggggaaatgacccaccagcacactacccccaaacattcaaagggtggtctcattaccatgccattcattattgcaaatgaggcatttgagaaggtagcaagctatggattgataccaaatatgatactgtacctgatgagagattacagcgtgggagtagcgaaggggaccaacatcctcttcctctggactgctggtacaaatttcatgccaattttgggagctttaatctctgattcatacttaggccgcttcctcaccattggcctgggttccatctccagtctcttgggaatgatcctactgtggttaacagcaatggttcccaaagttaggcctcctccctgtgacataacaactcaaagctgtaaaaccccaacaacgggccagatgactctgctgttgtcctccttcgcattgatgtccattggagctggtggcgttagaccatgttccatagcatttggtgctgaccaattggacaacaaatctaacccgaaaaatgaaagggtcttggagagcttctttggctggtactatgcctcggcagctatttctgtcttgatttctctgacggctatagtttatattcaagatcatcttggttggaaagtaggatttggagttcctgcaatccttatgttcctctctgctttgttgttcttctttgcttctccattttatgtaaagcaaaaaccaagtaaaagcttgttcactggctttatacaagtgcctgtcgttgcttacaagaacagaaaactcgcattcccgcccagagactctgatggttggtaccatcacaagagggactcaaagtttattgcgccaacaaccaaactaaggttcttgaacaaggcttgcatcatcagaaatcctgaacaagatatagcctcagatggatcggcatcaaatccgtggagtctatgcacaatagagcaagttgaagaactcaaggcgcttcttaaagtcatcccattgtggtccactgggataatgatatccataaacattagccaaagcacttttcaattgctccaagcaagttccatggaccgacacatttcttccagctttcaaatcccagctggctcttttggtatgttcacaatcatctctctggcaacatgggttatcctctatgatcgcgctatccttcccttggcatctaaaataaagggcaagccagtgcagttaggtgctaaactaaggatgggaattggcctatttctctcctgcatggccatggtagtttccgcaatagttgagagcattcggcgaaggaaagcaatccgggaagggtatttgaacaatgctcatgcggtattggatatgtctgcaatgtggcttgtgccgcaatattgcttgaatggattggcagaagccttcaacgcaataggccaaacagagttttattactcagagttccctaagagcatgtctagtattgcagctgcactattcggattaggaatggctgtggcaaacttattagcaagtgctatactaagcgcagttgataagctcacttcaagagggggcaaagagagctgggtttcaaataacattaacaagggtcattatgataactactactggcttcttgccataatgagttctgttaatttgctatattttctagtatgtagctgggcttacggaccttgtgtggagcgagtaataaaggtcagtgatgaggggaatggctttaaggaggaagaattttctaatataggagctattgttaaagacgaagtataa

SEQ ID NO: 2481 - protein, 593 aa, Populus balsamifera subsp. trichocarpa
  misc_feature (93)..(499): Pfam Name: PTR2 Pfam Description: POT family
  misc_feature (1)..(593): Ceres Annot ID no. 1492266
  misc_feature (1)..(593): Bit score of 600.0 for HMM based on sequences of Figure 38
  misc_feature (1)..(593): Functional Homolog Of SEQ ID NO. 2425
MEEPLSSQGEMTHQHTTPKHSKGGLITMPFIIANEAFEKVASYGLIPNMILYLMRDYSVGVAKGTNILFLWTAGTNFMPILGALISDSYLGRFLTIGLGSISSLLGMILLWLTAMVPKVRPPPCDITTQSCKTPTTGQMTLLLSSFALMSIGAGGVRPCSIAFGADQLDNKSNPKNERVLESFFGWYYASAAISVLISLTAIVYIQDHLGWKVGFGVPAILMFLSALLFFFASPFYVKQKPSKSLFTGFIQVPVVAYKNRKLAFPPRDSDGWYHHKRDSKFIAPTTKLRFLNKACIIRNPEQDIASDGSASNPWSLCTIEQVEELKALLKVIPLWSTGIMISINISQSTFQLLQASSMDRHISSSFQIPAGSFGMFTIISLATWVILYDRAILPLASKIKGKPVQLGAKLRMGIGLFLSCMAMVVSAIVESIRRRKAIREGYLNNAHAVLDMSAMWLVPQYCLNGLAEAFNAIGQTEFYYSEFPKSMSSIAAALFGLGMAVANLLASAILSAVDKLTSRGGKESWVSNNINKGHYDNYYWLLAIMSSVNLLYFLVCSWAYGPCVERVIKVSDEGNGFKEEEFSNIGAIVKDEV

SEQ ID NO: 2482 - protein, 592 aa, Vitis vinifera
  misc_feature (99)..(504): Pfam Name: PTR2 Pfam Description: POT family
  misc_feature (1)..(592): Public GI ID no. 225429973
  misc_feature (1)..(592): Bit score of 608.1 for HMM based on sequences of Figure 38
  misc_feature (1)..(592): Functional Homolog Of SEQ ID NO. 2425
MEQIIAEDQMGFAPNPNRSRYPPPKPRYGGFRTMPFIIVNQSLEKVAGFGIMPNMIFYLMNGYHMEAATGSTILFTWSAFSKSLAVFGALLSDFYLGRFRVIAFGSFSSLLGITLLWLTAMIPWLKPPPCDQLNDNCNSATPAQLAVLFTSLGLISVGAGCIRPCSIAFGADQLDNKENPDNDTVLQSFFNWYYASIGVSTVIALTFIAYIQDHLGWKFGFGVPVILMVFSALMFVLGSSLYIRVKPGKNLLTGFVQVLVVAFKNRCLTLPTDSVGYYNHSSDPKFLAPTSELRCLNKACIIRDPNRDLNSDGSTSNPWSLCSVELVESVKSLLRVIPLWSTGIMILMSMEQTSFSTLQANTMDRHITPNFEIPAGTFSVFTIITLTIWLPVYDCLLVPILARYTGQLRGLSPKVRMGIGLVLSCMAMAVAAATEMIRRRIATKQGLEDQPAATVNMSALWLLPQYVLLGLAEAFNGIGQNEFYYSQFPKSMSSLAGALFTLGLALSSFAGSLLVNVVNSVTTKGGKESWLSSNLNKGHLDYYYGLIAVLGMINFIYFLVCCRLYGPCEDEKTKLSGEVEVDQFLYSALPSS

SEQ ID NO: 2483 - DNA, 2000 bp, Gossypium hirsutum
  misc_feature (1)..(2000): Ceres Clone ID no. 1944137
  misc_feature (1)..(2000): Encodes the peptide sequence at SEQ ID NO. 2484
aggcaccttctatatccagaatacaaagatggaaagagtggaggaagatgaccctaaacaaaacaatgttaaaactaggcccaagggaggattggtcaccatgcctttcattttctcaaatgagatctgtgagaagctggcggtggtgggatttaataccaatatgataagctacttaacaacacagcttcatatgccattaaccaaagcagccaacactctcacaaattttggtggaacagctagcttgacaccattgcttggtgcctttatctctgattcatacgccggtcgtttctggacaataacagtcgcttccatcatataccaaatagggatgacatgtttaacactatcagcaatacttccacaacttaggccaccaccgtgtaaaggtgagcaagtctgccaacaagcaacggcagggcagttggcaatcctatacggatctctcttacttggggctttgggatcaggaggaatccggccttgtgtggttgctttcggggcagaccagttcgacgaaagcaacccaaaggaagcaacgaagacatggaaatacttcaattggtactactttgtgatgggggtatcaatacttgtggctgtcacagtgcttgtttacattcaagataacattgggtggggatggggccttggagtccccaccatcgccatgttcttgtccattatcacgttcatcatcggctatccactttatcgacacatggatccgtcagggagtccgtttacccgtttggtacaggtcagtgtgtcagctttcaagaagaggaagttggccatggtttctgaccccaacttgttgtatcggaatgatgagcttgacgcctccatttctgtagatggaaaacttgttcacaccccagacatgacattccttgacaaggcagccattctgacggaagaagatattgtaaaaccagggcaagctcctaatctatggagactgaacaccatccatcgagtggaggaactaaaagcagtgatccgaatgggaccgatatgggcagcaggaatcctcctcatcacagcctatgctcagcaaaacacattctccctccaacaggccaaaagcatgaacaggcacctcaccaagtcatttgagatccctgctggttccatgactgtcttcaccatggtctccatgctctccaccatagccttgtatgaccgtgttttggtccgcattgcccgtagatacacagggctcgagcgaggcatcagcttcctgcacaggatgggaataggattcatgatatcagtattagccactctggtagcaggcttcgtggaagtgaagcgtaaagaagcggctttagcacatgggcttcaagacaaggctcattcaatcatccccatctcagtgttctggcttgtgcctcagtacagtcttcatggaatagcagaggcattcatgtcgattggacacttggaattcttttatgatcaggcacctgaaagcatgaggagcacagctaccgcactgttttggactgcaatctcagtcggaaattacatgagcacgctgctggtttctttagtacacaaattcagcgcaagagctgatggatcaaattggcttccagataacaacttgaacgagggcaaattggagtacttttactggttgatcactgccttgcaagtggttaatcttatttactacatctgttgtgctaagctgtatacgtataagccgattcaaatccatggcaaagacagtggatctgaaggagatgcaggagtagagcttgcaagcaaggtttagtttttgcatttgaggaaactagatggtgaattcttgttcctttttctaaaactgtctagccatagatcttgtagagagagtctaatagattacaatctgaatcgtaggataggcatgtaaagtcctaaataacattagaaagaaaaatccaccaccaagtattgtattttgtaatagatgaaaaataaaaattctgaagctggtttctatt

SEQ ID NO: 2484 - protein, 586 aa, Gossypium hirsutum
  misc_feature (90)..(498): Pfam Name: PTR2 Pfam Description: POT family
  misc_feature (1)..(586): Ceres Clone ID no. 1944137
  misc_feature (1)..(586): Bit score of 612.2 for HMM based on sequences of Figure 38
  misc_feature (1)..(586): Functional Homolog Of SEQ ID NO. 2425
MERVEEDDPKQNNVKTRPKGGLVTMPFIFSNEICEKLAVVGFNTNMISYLTTQLHMPLTKAANTLTNFGGTASLTPLLGAFISDSYAGRFWTITVASIIYQIGMTCLTLSAILPQLRPPPCKGEQVCQQATAGQLAILYGSLLLGALGSGGIRPCVVAFGADQFDESNPKEATKTWKYFNWYYFVMGVSILVAVTVLVYIQDNIGWGWGLGVPTIAMFLSIITFIIGYPLYRHMDPSGSPFTRLVQVSVSAFKKRKLAMVSDPNLLYRNDELDASISVDGKLVHTPDMTFLDKAAILTEEDIVKPGQAPNLWRLNTIHRVEELKAVIRMGPIWAAGILLITAYAQQNTFSLQQAKSMNRHLTKSFEIPAGSMTVFTMVSMLSTIALYDRVLVRIARRYTGLERGISFLHRMGIGFMISVLATLVAGFVEVKRKEAALAHGLQDKAHSIIPISVFWLVPQYSLHGIAEAFMSIGHLEFFYDQAPESMRSTATALFWTAISVGNYMSTLLVSLVHKFSARADGSNWLPDNNLNEGKLEYFYWLITALQVVNLIYYICCAKLYTYKPIQIHGKDSGSEGDAGVELASKV

SEQ ID NO: 2485 - protein, 574 aa, Oryza sativa subsp. japonica
  misc_feature (91)..(493): Pfam Name: PTR2 Pfam Description: POT family
  misc_feature (1)..(574): Public GI ID no. 115440087
  misc_feature (1)..(574): Bit score of 511.0 for HMM based on sequences of Figure 38
  misc_feature (1)..(574): Functional Homolog Of SEQ ID NO. 2425
MEHSLVAEAEAQVFFKAKAKGGFRALPFIISNEILEKVAGFGLNINFITYLNMQYHLSHANAGSLLFVWGAVSNFAPIPGAVIADMYLGRFIVVAIGSIACFVGMVFLWLSAMIPGARPPPCDMSASPELCAPPEARHMAWLLAGFVFLSVGAGGVRPCSMAFGADQFSRHPKERRSRILQVYFNAYYGSIGVAFMVAVTVVVYVQDNLGWKVGLAVPTCLMLLSAASFLLGSGLYIKDRGSKRMFAGIGAAVAAAVRNRRAWLPAKTEDGVYHHLKDCKLTVPTDRLRFLNKACMISNTKEDKSGSGGADGISDRGRLCTVDQVEQLKSAIRVMPIWSSTIFLAQAMNQYFAVPQADAMDRRVGAGGFRVPSGTFAVFNMLTMSLWSGCYDRWTAPALRRLTGNPRGLTMKQRIGGGLVFGTAAMAAAAVVEAARRRQALGGGGMSAFWLVPQYALAGLAEAFGVIGVIEFFYTELPKSMASFSMALLYMALGAGSLVGSLIIKLVHEVSGRRGRTSWLAEDLNAGRYDYYYWLLAGLGAVNFVYFLWCGWAYGEEGQNVEWEDEGEGETTIA

SEQ ID NO: 2486 - DNA, 2047 bp, Arabidopsis thaliana
  misc_feature (1)..(2047): Ceres Annot ID no. 875119
  misc_feature (1)..(2047): Encodes the peptide sequence at SEQ ID NO. 2487
ataagctcatgctcattattactccgacaagtgccgtgtaattcctcgccctcggctactcttttctcttcttgcctctcgtctccgccgctgattcagctgccgccgacaaaggaatatggaagaaaaagatgtgtatacgcaagatggaactgttgatattcacaaaaatcctgcaaacaaggagaaaaccggaaattggaaagcttgccgcttcattctcggaaatgagtgctgtgaaagattggcctactatggcatgggcactaaccttgtgaattatcttgagagccgtctgaatcaaggcaatgctacggctgcaaataacgtcacgaattggtctggaacatgttatataactcctttgattggagcctttatagctgatgcttaccttggacgatattggactattgcaacttttgttttcatctatgtctccggtatgactcttttgacattatcagcttcagttcctggacttaaaccaggtaactgcaatgctgatacttgtcatccaaattctagtcagactgctgttttctttgtcgcgctttatatgattgctcttggaactggcggtataaagccgtgtgtttcgtcctttggagctgatcagtttgatgagaatgatgagaatgagaagatcaagaaaagttctttcttcaactggttttacttctccattaatgttggagctctcattgctgcaactgttctcgtctggatacaaatgaatgttggttggggatggggtttcggtgttccaacagtcgcgatggttatcgcggtttgctttttcttcttcggaagccgtttttacagacttcagagacctggagggagtccacttactaggatctttcaggttatagtagcggcttttcggaagataagtgttaaggttccagaggacaagtctctgctctttgaaactgcagatgatgagagtaacatcaaaggtagccggaaacttgtgcacacagataacttaaagttttttgacaaggcagcggttgagagtcaatctgatagcatcaaagacggggaagtcaatccatggagactatgttctgttactcaagttgaagaacttaagtcaataatcacacttcttccagtttgggccacaggaatagtcttcgccacagtgtacagccaaatgagcacaatgtttgtgttacaaggaaacacaatggaccaacacatgggaaaaaactttgaaatcccatcagcttcactctcacttttcgacactgtcagtgtactcttctggactcctgtctatgaccagttcattatcccgctggcaagaaagttcacacgcaatgaacgaggcttcactcagcttcaacgtatgggtataggtcttgtggtctccatctttgccatgatcactgcaggagtcttggaggttgtcaggcttgattatgtcaaaactcacaatgcatatgaccaaaaacagatccatatgtcgatattctggcagataccgcagtatttacttatcggttgtgcagaagttttcacctttataggtcagcttgagtttttctatgatcaggctcctgatgccatgagaagtctctgctctgctttgtcgttgaccacggttgcgttggggaactatttgagcacagttcttgtgacggttgtgatgaagataacgaagaagaacggtaaaccgggttggataccggataacttgaaccgaggccatcttgattactttttctacttgttggcaactctcagtttcctcaacttcttagtgtacctctggatttcaaaacgctacaaatacaagaaagctgttggtcgagcacattgatcaagaaactggtgtggaagatatttggagttaacagtatttgtttgaaaagtgttttgcttgtaaatgttttttgtatgtggtctagttgttgttggtgtgttaggtttgttttggttttgcttatgtatttctgaatacttccagtcttccacttatatgtaaaaggctattggtaactattttatgagctttttgcttaaagctttttgaccg

SEQ ID NO: 2487 - protein, 570 aa, Arabidopsis thaliana
  misc_feature (96)..(499): Pfam Name: PTR2 Pfam Description: POT family
  misc_feature (1)..(570): Ceres Annot ID no. 875119
  misc_feature (1)..(570): Bit score of 540.8 for HMM based on sequences of Figure 38
  misc_feature (1)..(570): Functional Homolog Of SEQ ID NO. 2425
MEEKDVYTQDGTVDIHKNPANKEKTGNWKACRFILGNECCERLAYYGMGTNLVNYLESRLNQGNATAANNVTNWSGTCYITPLIGAFIADAYLGRYWTIATFVFIYVSGMTLLTLSASVPGLKPGNCNADTCHPNSSQTAVFFVALYMIALGTGGIKPCVSSFGADQFDENDENEKIKKSSFFNWFYFSINVGALIAATVLVWIQMNVGWGWGFGVPTVAMVIAVCFFFFGSRFYRLQRPGGSPLTRIFQVIVAAFRKISVKVPEDKSLLFETADDESNIKGSRKLVHTDNLKFFDKAAVESQSDSIKDGEVNPWRLCSVTQVEELKSIITLLPVWATGIVFATVYSQMSTMFVLQGNTMDQHMGKNFEIPSASLSLFDTVSVLFWTPVYDQFIIPLARKFTRNERGFTQLQRMGIGLVVSIFAMITAGVLEVVRLDYVKTHNAYDQKQIHMSIFWQIPQYLLIGCAEVFTFIGQLEFFYDQAPDAMRSLCSALSLTTVALGNYLSTVLVTVVMKITKKNGKPGWIPDNLNRGHLDYFFYLLATLSFLNFLVYLWISKRYKYKKAVGRAH

SEQ ID NO: 2488 - protein, 574 aa, Oryza sativa subsp. indica
  misc_feature (91)..(493): Pfam Name: PTR2 Pfam Description: POT family
  misc_feature (1)..(574): Public GI ID no. 125527793
  misc_feature (1)..(574): Bit score of 493.8 for HMM based on sequences of Figure 38
  misc_feature (1)..(574): Functional Homolog Of SEQ ID NO. 2425
MEHSLVAEAEAQVFFKAKAKGGFRALPFIISNEILEKVAGFGLNINFITYLNMQYHLSHANAGSLLFVWGAVSNFAPIPGAVIADMYLGRFIVVAIGSIACFVGMVFLWLSAMIPGARPPPCDMRASPELCAPPEARHMAWLLAGFVFLSVGAGGVRPCSMAFGADQFSRHPKERRSRILQVYFNAYYGSIGVAFMVAVTVVVYVQDNLGWKVGLAVPTCLMLLSAASFLLGSGLYIKDRGSKRMFAGIGAAVAAAVRYRRAWLPAKTEDGVYHHLKDCKLTVPTDRLRFLNKACMIRNTKEDKSGSGGADGISDRGRLCTVDQVEQLKSAIRVMPIWSSTIFLAQAMNQYFAVPQADAMDRRVGAGGFRVPSGTFAVFNMLTMSLWSGCYDRWTAPALRRLTGNPRGLTMKQRIGGGLVFGTAAMAAAAVVEAARRRQALGGGGMSAFWLVPQYALAGLAEAFGVIGVIEFFYTELPKSMASFSMALLYMALGAGSLVGSLIIKLVHEVSRRGGRTSWLAEDLNAGRYDYYYWLLAGLGAVNFVCFLWCGWAYGEEGQNVEWEDEGEGETTIA

SEQ ID NO: 2489 - protein, 594 aa, Picea sitchensis
  misc_feature (121)..(527): Pfam Name: PTR2 Pfam Description: POT family
  misc_feature (1)..(594): Public GI ID no. 116788004
  misc_feature (1)..(594): Bit score of 554.8 for HMM based on sequences of Figure 38
  misc_feature (1)..(594): Functional Homolog Of SEQ ID NO. 2425
MGVEGEGSVETALLEEGSISSVQTGKASEDEYTGDGSVDFWGRPSVKENTGNWRACPFILGNECCERLAYYGINTNLVTYLTKRLHQGNAAAAKSVTTWAGTCYLTPLFGAVLADAYWGRYWTIAAFSTIYFIGMATLTLSASVSSLKPPSCIGSDCPTANLAQYGVFFLGLYLIALGTGGIKPCVSSFGADQFDDTDPKEKKKKGSFFNWFYFSINVGALVSSSVLVWVQDNVGWGWGFGIPTLFMGLAIGSFFSGTPLYRLQKPGGSPVTRMCQVVVASLRKLRKTVPLDHSHLYEVQDRNSAIQGSRKLEHTDEFKCLDKSAIITDDDVRKGGFSNPWRLCTVTQVEEMKILLRMFPIWATGIVFAAVYSQISTMFVEQGMTLDTSIGSRFHIPPASLSVFDVVSVMIWVPVYDRVIVPIVSKYTKRERGFTELQRMGIGLFISILAMVAAALVEIRRLNIVKTYDLVYDKGTPVPMSIFWQIPQYFLVGASEVFTFVGQLEFFYDQSPDAMRSLCSALSLLTTALGNYLSSLIVTIVMFATTKGGNIGWIPDNLNEGHLDYYFWVLASLSVLNLLVYVSCAHRYKYKKAS

SEQ ID NO: 2490 - protein, 604 aa, Cucumis sativus
  misc_feature (107)..(513): Pfam Name: PTR2 Pfam Description: POT family
  misc_feature (1)..(604): Public GI ID no. 15391731
  misc_feature (1)..(604): Bit score of 582.6 for HMM based on sequences of Figure 38
  misc_feature (1)..(604): Functional Homolog Of SEQ ID NO. 2425
MEIESLRVSVDEKVLKDEEKNEKEEMKMKMKMKRKLGGVKTMPFILGNEVCDRFASSGFHSNIITYLTQDLNMPLVPASNILTNFAATSSFTSLIGALIADSFAGRFWTITIASIIYELGMVTITISAILPSLHPPPCPTQINCTQASGTQLMILYLALLLTSLGAGGIRPCVVAFAADQFDMTKVGIAGRTWNFFNWYYFCMGMATLTALTVVVYIQDNVGWGWGFGLPTIAMALSVVAFVVGSPLYNKLKPSGSPLVRLAQVVVAAFKNRKAVLPDDSKLLYRNHELDAAIAIQGRLVHTDQFKWLDKAAVITSPDSTANPPNLWRLATVHRVEELKSIIRMLPIWAAGILLVTASSHQHSFTIQQARTMNRHLTPTFQIPPATLSIFGILSMLTGLVLYDRLLVPFAKKLTHNPSGITCLQRMGVGFAINILATLVSSIVEIKRKKVAANHGLLDNPTATIPFSVFWLVPQFWLHGIAEVFMSVGHLEFMYDQSPESLRSTATALYWLAISVGNYIGTLMVYLVHKYTGEEHNWLPDRNLNRGRLEYYYWLVSGIQVMNLVYYVICAWFYTYKPLEEEKINIENKDGDQEWERCEDTIKIA

SEQ ID NO: 2491 - protein, 569 aa, Physcomitrella patens subsp. patens
  misc_feature (77)..(490): Pfam Name: PTR2 Pfam Description: POT family
  misc_feature (1)..(569): Public GI ID no. 168064734
  misc_feature (1)..(569): Bit score of 602.7 for HMM based on sequences of Figure 38
  misc_feature (1)..(569): Functional Homolog Of SEQ ID NO. 2425
SKTRRIGGWISTPFIFGNEMGERLAGFGLSMNLITFLTLEMHMPTVKAANIITNFGGTCGLTPLVGAFIADAYLGRFKTIAITSIIYMLGVVLLTLSAAFSSLRPPSCNYHMGVSSLICKEPSSKQLWYFFSSLFLLAVGTGGIRPNTAPFGADQFDPSHPKEKNQLWHFFNWYYFCVGISILGALTVIVWVQDNVGWTWGFGIPAGAMAIALLSFFIGAPFFRYMPPVGSPFTRIAQVIVASYRKRKLSLPSDTSLLHRRNDKGELINYPAVIELHHSNQFTLLDKAAIVEEDNNMSSHASRWRLCTVHQIEELKSLLRMAPIWMTTILVSTVIVQQGTFSVQQARTMNRWMGYNFQMPAASFGVFGILMLLTWVPIYDLYVMGWLKKVTGNERGVTPLQRIGAGLFIAILSMVAAAAVEVKRRNVAHRHGLLDRPDLTVPISAFWLVPQHCLFGLAESFVFIGELEFFYDQSPESMRSTGTALFWSTFALGNYVSTALVTLIDHNTNWLENNLNRAHLDHFYWFLAVLSTVNLLFFLLSAHWFRYRNEGLDPDLDIHLETSAALKPN

SEQ ID NO: 2492 - DNA, 1261 bp, Arabidopsis thaliana
  misc_feature (1)..(1261): Ceres Annot ID no. 878887
  misc_feature (1)..(1261): Ceres SEED LINE ID no. CW00551
  misc_feature (1)..(1261): Encodes the peptide sequence at SEQ ID NO. 2493
aatactactactcactttactataatctctcaaaatggccgtaagtttcgtaacaacatctcctgaggaagaagacaaaccgaagctaggccttggaaatattcaaactccgttaatcttcaacccttcaatgcttaaccttcaagccaatatcccaaaccaattcatctggcctgacgacgaaaaaccttccatcaacgttctcgagcttgatgttcctctcatcgaccttcaaaaccttctctctgatccatcctccactttagatgcttcgagactgatctctgaggcctgtaagaagcacggtttcttcctcgtggtcaatcacggcatcagcgaggagcttatttcagacgctcatgaatacacgagccgcttctttgatatgcctctctccgaaaaacagagggttcttagaaaatccggtgagagtgttggctacgcaagcagtttcaccggacgcttctccaccaagcttccatggaaggagaccctttctttccggttttgcgacgacatgagccgctcaaaatccgttcaagattacttctgcgatgcgttgggacatgggtttcagccatttgggaaggtgtatcaagagtattgtgaagcaatgagttctctatcactgaagatcatggagcttctggggctaagtttaggcgtaaaacgggactactttagagagtttttcgaagaaaacgattcaataatgagactgaattactaccctccatgtataaaaccagatctcacactaggaacaggacctcattgtgatccaacatctcttaccatccttcaccaagaccatgttaatggccttcaagtctttgtggaaaatcaatggcgctccattcgtcccaaccccaaggcctttgtggtcaatatcggcgatactttcatggctctatcgaacgatagatacaagagctgcttgcaccgggcggtggtgaacagcgagagcgagaggaaatcacttgcattcttcttgtgtccgaaaaaagacagagtagtgacgccaccgagagagcttttggacagcatcacatcaagaagataccctgacttcacatggtctatgttccttgagttcactcagaaacattatagagcagacatgaacactctccaagccttttcagattggctcaccaaacccatctaagaaataaaatattcatgtcttgtcttgttagttactagtatcttctttatatttcatgtatgtatatggtaataggcaataacaccttttagc

SEQ ID NO: 2493 - protein, 377 aa, Arabidopsis thaliana
  misc_feature (223)..(322): Pfam Name: 2OG-FeII_Oxy Pfam Description: 2OG-Fe(II) oxygenase superfamily
  misc_feature (1)..(377): Ceres SEED LINE ID no. CW00551
  misc_feature (1)..(377): Ceres Annot ID no. 878887
  misc_feature (1)..(377): Bit score of 836.4 for HMM based on sequences of Figure 31
  misc_feature (1)..(377): in Figure 31
MAVSFVTTSPEEEDKPKLGLGNIQTPLIFNPSMLNLQANIPNQFIWPDDEKPSINVLELDVPLIDLQNLLSDPSSTLDASRLISEACKKHGFFLVVNHGISEELISDAHEYTSRFFDMPLSEKQRVLRKSGESVGYASSFTGRFSTKLPWKETLSFRFCDDMSRSKSVQDYFCDALGHGFQPFGKVYQEYCEAMSSLSLKIMELLGLSLGVKRDYFREFFEENDSIMRLNYYPPCIKPDLTLGTGPHCDPTSLTILHQDHVNGLQVFVENQWRSIRPNPKAFVVNIGDTFMALSNDRYKSCLHRAVVNSESERKSLAFFLCPKKDRVVTPPRELLDSITSRRYPDFTWSMFLEFTQKHYRADMNTLQAFSDWLTKPI

SEQ ID NO: 2494 - protein, 382 aa, Phaseolus vulgaris
  misc_feature (227)..(326): Pfam Name: 2OG-FeII_Oxy Pfam Description: 2OG-Fe(II) oxygenase superfamily
  misc_feature (1)..(382): Public GI ID no. 2262201
  misc_feature (1)..(382): Bit score of 913.7 for HMM based on sequences of Figure 31
  misc_feature (1)..(382): Functional Homolog Of SEQ ID NO. 2493
  misc_feature (1)..(382): in Figure 31
MAIDCMTNIQTMSQPQKHHHQDNKEDEAPLVFDASLLRHQLNLPKQFIWPDDEKPCMNVPELVVPLIDLRGFLSGDPVATMEAARMVGEACQKHGFFLVVNHGIDANLISHAHSYMDDFFEVPLTQKQRAQRKTGEHCGYASSFTGRFSSKLPWKETLSFQFSAEEKSSTIVKDYLCNTLGQEFEQFGRVYQDYCDAMSNLSLGIMELLGMSLGVGKACFREFFEENDSIMRLNYYPPCQKPDLTLGTGPHCDPTSLTILHQDQVGGLQVFVDNEWHSINPNFNAFVVNIGDTFMALSNGRYKSCLHRAVVNSKTTRKSLAFFLCPKGDKVVSPPSELVDDLTPRLYPDFTWPMLLEFTQKHYRADMKTLEAFTNWLQQKRS

SEQ ID NO: 2495 - protein, 383 aa, Citrus sinensis x Poncirus trifoliata
  misc_feature (225)..(324): Pfam Name: 2OG-FeII_Oxy Pfam Description: 2OG-Fe(II) oxygenase superfamily
  misc_feature (1)..(383): Public GI ID no. 8919865
  misc_feature (1)..(383): Bit score of 915.9 for HMM based on sequences of Figure 31
  misc_feature (1)..(383): Functional Homolog Of SEQ ID NO. 2493
  misc_feature (1)..(383): in Figure 31
MAIDCIKNIPTMLHQPKEEYKDEQKPLVFDASVLKHQTQIPKQFIWPDDEKPCVNAPELQVPLIDLGGFLSDDPVAAKEASRLVGEACRKHGFFLVVNHGVDSSLIADAHRYMDHFFELPLNEKQRARRKLGEHCGYASSFTGRFSSKLPWKETLSFRYSAEKSLSNNIVEDYLLNTMGDEFKQFGRVYQDYCESMSRLSLGIMELLAISLGVGRAHFKEFFEENDSIMRLNYYPPCQKPELTLGTGPHCDPTSLTILHQDQVGGLQVFVDNEWRSISPNFEAFVVNIGDTFMALSNGRYKSCLHRAVVNSQTTRKSLAFFLCPKNDKVVSPPSELVDTYSSPRIYPDFTWPMLLEFTQKHYRADMKTLEAFTNWLQQKKQLK

SEQ ID NO: 2496 - protein, 380 aa, Pisum sativum
  misc_feature (225)..(324): Pfam Name: 2OG-FeII_Oxy Pfam Description: 2OG-Fe(II) oxygenase superfamily
  misc_feature (1)..(380): Public GI ID no. 2108428
  misc_feature (1)..(380): Bit score of 897.9 for HMM based on sequences of Figure 31
  misc_feature (1)..(380): Functional Homolog Of SEQ ID NO. 2493
  misc_feature (1)..(380): in Figure 31
MAIECITSSAKLMTQKSDKNENEESSKLVFDASFLKNQLNLPKQFIWPDDEKPCMNVPELDVPLIDFKNFLSGDPFAAMEASKTIGEACEKHGFFLVVNHGIDTKLIEHAHSYMNDFFEVPLSQKQRCQRKTGEHCGYASSFTGRFSSNLPWKETLSFQFSDEKNSSNIVKDYLSNTLGEDFQQFGEVYQEYCEAMSKLSLGIMELLGMSLGVGKECFRDFFEENKSIMRLNYYPPCQKPDLTLGTGPHCDPTSLTILHQDQVGGLQVFVDNEWHSIRPNFNAFVVNIGDTFMALSNGRYKSCLHRAVVNNKTTRKSLAFFLCPKGDKVVSPPSELVNDLTPRIYPDFTWPMLLEFTQKHYRADMRTLEAFTKWIQQKQN

SEQ ID NO: 2497 - protein, 380 aa, Pisum sativum
  misc_feature (225)..(324): Pfam Name: 2OG-FeII_Oxy Pfam Description: 2OG-Fe(II) oxygenase superfamily
  misc_feature (1)..(380): Public GI ID no. 1848146
  misc_feature (1)..(380): Bit score of 893.8 for HMM based on sequences of Figure 31
  misc_feature (1)..(380): Functional Homolog Of SEQ ID NO. 2493
  misc_feature (1)..(380): in Figure 31
MAIECITSSAKLMTQKSDKNENEESSKLVFDASFLKNQLNLPKRFIWPDDEKPCMNVPELDVPLIDFKNFLSGDPFAAMEASKTIGEACEKHGFFLVVNHGIDTKLIEHAHSYMNDFFEVPLSQKQRCQRKTGEHCGYASSFTGRFSSNLPWKETLSFQFSDEKNPSHIVKDYLSNTLGEDFQQFGEVYQEYCEAMSKLSLGIMELLGMSLGVGKECFRDFFEENKSIMRLNYYPPCQKPDLTLGTGPHCDPTSLTILHQDQVGGLQVFVDNEWHSIRPNFNAFVVNIGDTFMALSNGRYKSCLHRAVVNNKTTRKSLAFFLCPKGDKVVSPPSELVNDLTPRIYPDFTWPMLLEFTQKHYRADMRTLEAFTKWIQQKQN

SEQ ID NO: 2498 - protein, 379 aa, Fagus sylvatica
  misc_feature (224)..(323): Pfam Name: 2OG-FeII_Oxy Pfam Description: 2OG-Fe(II) oxygenase superfamily
  misc_feature (1)..(379): Public GI ID no. 18496057
  misc_feature (1)..(379): Bit score of 914.2 for HMM based on sequences of Figure 31
  misc_feature (1)..(379): Functional Homolog Of SEQ ID NO. 2493
  misc_feature (1)..(379): in Figure 31
MAIDCITNITSMPHPPKEEHKDHQKQLVFDASVLRHQTNIPQQFIWPDEEKPRANAPELQVPLIDLRGFLSGDPTAANEASSLVGKACQKHGFFLVVNHGVDDKLIAHAHQYIDYFFELPMSAKQRAQRKVGEHCGYASSFTGRFSFKLPWKETLSFRSSAQPDSSNIVQDYLCNTMGEDFKPFGKVYQDYCDAMSTLSLGIMELLGMSLGVSQGHYREFFEENESIMRLNYYPPCQKPDLTLGTGPHCDPTSLTILHQDQVGGLQVFVDEEWRSITPNFNAFVVNIGDTFMALSNGRYKSCLHRAVVNSKTPRKSLAFFLCPKNDKVVSPPSELVDSLCPRVYPDFTWPMLLEFTQKHYRADVKTLEVFSNWLQQKNS

SEQ ID NO: 2499 - DNA, 1158 bp, Populus balsamifera subsp. trichocarpa
  misc_feature (1)..(1158): Ceres Annot ID no. 1474270
  misc_feature (1)..(1158): Encodes the peptide sequence at SEQ ID NO. 2500
atggcaatagattgcatcaaaaccatgccatccataaccacccctcatcaccacccaaaagatcaggatcaatgcaaagatgatggcaagtcttttgtttttgatgcacaagttcttcgacaccagacaaacataccccagcagttcatttggcctgaccatgaaaagcctaatattaatgcacctgaactccaagtcccacttgtagacttgggtgatttcctctctggtaaccctgttgctgcagtggaagcttcaagacttgttggtgaagcatgtcaaaaacatggtttctttctagttgttaatcatggagttgataaaacgctcattgcccatgctcataattacatggacaccttcttcgaattgccactttctgagaaacaaaaggcccaaagaaagattggcgagtcttgtggatatgctagcagctttactggcaggttttcctctaaacttccatggaaagaaacgctttcttttcgctacacagctgagaagaattcatcaaaacacatcgaggaatactttcataacagaatgggggaagatttcgctgaattcgggagtgtgtatcaggactactgtgaggccatgagcactttgtcactagggatcatggagctattaggcatgagccttggtgtgagcagagaacatttcagggaattctttgatgagaatgattcaataatgaggctcaactactaccctccatgccaaaaacctgaccttactttaggcaccggtcctcattgtgatccaacttctttgaccatccttcatcaagaccaagtgggtggtcttcaagtgtttgtggacaacgaatggcgttcgattagccccaattttgacgcttttgttgttaacattggtgacaccttcatggctctatcgaatggtatatacaagagctgtttgcaccgagcagtggtgaacagccaaacaccaagaaaatccctcgctttctttttgtgtccaaagaatgacaagatggtaactccaccacatgaattagtggacacatgcaatccgagaatatatccagatttcacatggcctatgttgctcgaattcacacaaaagcattaccgagctgacatgaagacacttgaggtgttcacaaactggcttcatcaacaaagttttagctga

SEQ ID NO: 2500 - protein, 385 aa, Populus balsamifera subsp. trichocarpa
  misc_feature (229)..(328): Pfam Name: 2OG-FeII_Oxy Pfam Description: 2OG-Fe(II) oxygenase superfamily
  misc_feature (1)..(385): Ceres Annot ID no. 1474270
  misc_feature (1)..(385): Bit score of 905.3 for HMM based on sequences of Figure 31
  misc_feature (1)..(385): Functional Homolog Of SEQ ID NO. 2493
  misc_feature (1)..(385): in Figure 31
MAIDCIKTMPSITTPHHHPKDQDQCKDDGKSFVFDAQVLRHQTNIPQQFIWPDHEKPNINAPELQVPLVDLGDFLSGNPVAAVEASRLVGEACQKHGFFLVVNHGVDKTLIAHAHNYMDTFFELPLSEKQKAQRKIGESCGYASSFTGRFSSKLPWKETLSFRYTAEKNSSKHIEEYFHNRMGEDFAEFGSVYQDYCEAMSTLSLGIMELLGMSLGVSREHFREFFDENDSIMRLNYYPPCQKPDLTLGTGPHCDPTSLTILHQDQVGGLQVFVDNEWRSISPNFDAFVVNIGDTFMALSNGIYKSCLHRAVVNSQTPRKSLAFFLCPKNDKMVTPPHELVDTCNPRIYPDFTWPMLLEFTQKHYRADMKTLEVFTNWLHQQSFS

SEQ ID NO: 2501 - protein, 382 aa, Acacia mangium
  misc_feature (227)..(326): Pfam Name: 2OG-FeII_Oxy Pfam Description: 2OG-Fe(II) oxygenase superfamily
  misc_feature (1)..(382): Public GI ID no. 160623443
  misc_feature (1)..(382): Bit score of 887.1 for HMM based on sequences of Figure 31
  misc_feature (1)..(382): Functional Homolog Of SEQ ID NO. 2493
  misc_feature (1)..(382): in Figure 31
MVVECITNNLPSMPHPAKHGTKEDKEDEPLVFDASLLRYEHNLPKQFIWPDEEKPCLNPPELVVPLVDLRGFLSGDPVAAMETSKLVSEACRKHGFFLVVNHGIDSRLISHAHRFMDDFFELPLSQKQRAQRKTGEHCGYASSFTSRFSSKLPWKETLSFQFSADKNSQNLVKDYLCEKVGHEFEQFGMVYQEYCEAMSNLSLVIMELLGMSLGVGRTCFREFFDKNNSIMRLNYYPPCQKPDLTLGTGPHCDPTSLTILHQDKVGGLQVYVDNEWHSITPNFNAFVVNIGDTFMALSNGRYKSCLHRAVVNSQTTRKSLAFFLCPGDDKVVTPPSELVDHVSPRIYPDFTWPMLLEFTQKHYRADMNTLEQFANWVQRNKS

SEQ ID NO: 2502 - protein, 379 aa, Helianthus annuus
  misc_feature (222)..(321): Pfam Name: 2OG-FeII_Oxy Pfam Description: 2OG-Fe(II) oxygenase superfamily
  misc_feature (1)..(379): Public GI ID no. 187455574
  misc_feature (1)..(379): Bit score of 898.9 for HMM based on sequences of Figure 31
  misc_feature (1)..(379): Functional Homolog Of SEQ ID NO. 2493
  misc_feature (1)..(379): in Figure 31
MAIDCIIKNPSPMSSLKEDRQRSLVFDASVLQHEGNIPQQFIWPDHEKPNTQKSKELEVPLIDLGGFLSGHSCSTKKASNLVGEACQKHGFFLVVNHGVDENLISDAHQYMDLFFELPLSEKQRAQRKAGESCGYASSFTGRFSSKLPWKETLSFQYSADENSSDIVKDYFKDKMGEEFIRLGNVYQDYCNAMNRLSLGIMELLGMSLGVSRAHFKEFFQENNSIMRLNYYPPCQKPDLTLGTGPHCDPTSLTILHQDNVGGLEVFVDNEWRSIAPNSQAFVVNIGDTFMALSNGRYKSCLHRAVVNSKTPRKSLAFFLCPKKDKVVSPPEKLVDQKNPRIYPDFTWSTFLEFTQKHYRADMNTLKAFSNWVQQETSRT

SEQ ID NO: 2503 - protein, 379 aa, Nicotiana tabacum
  misc_feature (222)..(321): Pfam Name: 2OG-FeII_Oxy Pfam Description: 2OG-Fe(II) oxygenase superfamily
  misc_feature (1)..(379): Public GI ID no. 30519873
  misc_feature (1)..(379): Bit score of 897.9 for HMM based on sequences of Figure 31
  misc_feature (1)..(379): Functional Homolog Of SEQ ID NO. 2493
  misc_feature (1)..(379): in Figure 31
MAIDCMITNVNSPMLRILEDDKKPLIFDASQMKREYNIPTQFIWPDDEKPRAVARELPVPLIDLGGFLSGDPVAAQQASRLVGEACRNHGFFLVVNHGVNANLISNAHRYMDMFFDLPLSEKQKAQRKLEEHCGYASSFTGRFSSKLPWKETLSFRYSAEEDSSHIVEEYFQNTMGESFSHLGNVYQEYCNSMSTLSLGIMELLGMSLGVGREHFKEFFEENESIMRLNYYPPCQKPDLTLGTGPHCDPTSLTILHQDSVGGLQVFVDNEWRSVSPNFNAFVVNIGDTFMALSNGRYKSCLHRAVVNNKTPRKSLAFFLCPKKDKVVSPPNELVDTNNPRIYPDFTWPTLLEFTQKHYRADMNTLQTFSNWLKQKTAQV

SEQ ID NO: 2504 - protein, 382 aa, Vitis vinifera
  misc_feature (224)..(323): Pfam Name: 2OG-FeII_Oxy Pfam Description: 2OG-Fe(II) oxygenase superfamily
  misc_feature (1)..(382): Public GI ID no. 99032729
  misc_feature (1)..(382): Bit score of 888.7 for HMM based on sequences of Figure 31
  misc_feature (1)..(382): Functional Homolog Of SEQ ID NO. 2493
  misc_feature (1)..(382): in Figure 31
MSIVCVEGNPPSMFNPPTDDHKNQEPLVFDASVLRHQSNIPKQFIWPDAEKPGDKATELSVPLIDLGGFLSGDPAAAMEATRLVREACQKHGFFLVVNHGVDDKLIYKAHQYMDSFFGLPLAKKQRAQRKLGEHCGYASSFIGRFSSKLPWKETLSFSYSAEKKSSNAVQEYFLNKMGEDFSEFGQVYQDYCEAMSTLSLVIMELLGMSLGIGGAHFREFFEENDSIMRLNYYPPCLKPDLTLGTGPHCDPTSLTILHQDQVGGLQVFVDDKWWSISPNFDAFVVNIGDTFMALSNGRYKSCLHRAVVNSQTPRKSLAFFLCPEKDKVVRPPTELVDTNSPRIYPDFTWSNLLEFTQKHYRADMKTLEVFSSWLQQKTAEAG

SEQ ID NO: 2505 - protein, 376 aa, Chrysanthemum x morifolium
  misc_feature (221)..(320): Pfam Name: 2OG-FeII_Oxy Pfam Description: 2OG-Fe(II) oxygenase superfamily
  misc_feature (1)..(376): Public GI ID no. 190192210
  misc_feature (1)..(376): Bit score of 870.7 for HMM based on sequences of Figure 31
  misc_feature (1)..(376): Functional Homolog Of SEQ ID NO. 2493
  misc_feature (1)..(376): in Figure 31
MIKSHSSLLSSHKELMDCQKTPLVFDSLILQHETNIPQQFIWPDHEKPNLQKTKELVVPLVDLGGFLSGRPSSAKEASLVVGDACKKHGFFLVTNHGVDASLIADAHRYMDLFFELPLSDKQRAQRKLGESCGYASSFTGRFTSKLPWKETLSFQFSGEKSSANGVKDYFENTLGKEFTRLGKVYQEYCNAMSRLSLGIMELLGMSLGVHRAHFKEFFEENDSIMRLNYYPRCQKPDQTLGTGPHCDPTSLTILHQDSVGGLEVFIDNEWRSIAPNSNAFVVNIGDTFMALSNGRYKSCLHRAVVNNRIHRKSLAFFLCPKKDKVVSPPDELVDENNPRIYPDFTWSTFLEFTQKHYRADMNTLQAFSNWIQQKNS

SEQ ID NO: 2506 - protein, 369 aa, Lactuca sativa
  misc_feature (214)..(313): Pfam Name: 2OG-FeII_Oxy Pfam Description: 2OG-Fe(II) oxygenase superfamily
  misc_feature (1)..(369): Public GI ID no. 4164143
  misc_feature (1)..(369): Bit score of 859.3 for HMM based on sequences of Figure 31
  misc_feature (1)..(369): Functional Homolog Of SEQ ID NO. 2493
  misc_feature (1)..(369): in Figure 31
MPSLHKEHINAQPKPLVFDSLILQHETNIPEQFIWPDHEKPNSQKAKELAVPLVDLRGFLSGRASSAKEASVVVGEACKKHGFFLVTNHGVDASLIVDAHRYMDLFFELPFLDKQRVQRKIGESCGYASSFTGRFSSKLPWKETLSFQFSGEKKSSKIVEEYFEKTMGKEFARLGKVYQEYCNAMSRLSLGIMELLGMSLGVEQSHFKEFFKENDSIMRLNYYPPCQKPDLTLGTGPHCDPTSLTILHQDTVGGLEVFIDNEWRSIAPNLNTFVVNIGDTFMALSNGQYRSCLHRAVVNNKIHRKSLAFFLCPKKDKVVSPPDELVDEKNPRIYPDFTWSTFLEFTQKHYRADMNTLQAFTNWIQQKNS

SEQ ID NO: 2507 - protein, 378 aa, Solanum lycopersicum
  misc_feature (218)..(317): Pfam Name: 2OG-FeII_Oxy Pfam Description: 2OG-Fe(II) oxygenase superfamily
  misc_feature (1)..(378): Public GI ID no. 4321496
  misc_feature (1)..(378): Bit score of 885.6 for HMM based on sequences of Figure 31
  misc_feature (1)..(378): Functional Homolog Of SEQ ID NO. 2493
  misc_feature (1)..(378): in Figure 31
MAIDCMITNGKSPMLDEKKQFIFDASHMKRESNIPTQFIWPDHEKPCALVQQLHVPLIDLRGFLSGDPDAAQQASELVGEACRGHGFFLVVNHGVDANLISNAHRYMDTFFELPLLEKQKAQRKIGEHCGYASSFTGRFSSKLPWKETLSFRYSAKKESSHIVEEYFQSTLGESFNHLGNVYQEYCNSMNTLSLGIMELLGMSLGVEKSHFKEFFEENDSIMRLNYYPPCQKPELALGTGPHCDPTSLTILHQDCVGGLQVFVDDEWRSISPNFNAFVVNIGDTFMALSNGRYKSCLHRAVVNNKTPRKSLAFFLCPNKDKVVSPPNELVDSNNPRIYPDFTWPTLLEFTQKHYRADMNTLQTFSNWLHDQHNTTTQA

SEQ ID NO: 2508 - protein, 399 aa, Rumex palustris
  misc_feature (220)..(319): Pfam Name: 2OG-FeII_Oxy Pfam Description: 2OG-Fe(II) oxygenase superfamily
  misc_feature (1)..(399): Public GI ID no. 109729787
  misc_feature (1)..(399): Bit score of 831.9 for HMM based on sequences of Figure 31
  misc_feature (1)..(399): Functional Homolog Of SEQ ID NO. 2493
  misc_feature (1)..(399): in Figure 31
MAIECMHKTDHEVKQGREPLSLVFDSKILRNQASIPKEFIWPDDEKPDHEAAELEVPVIDMEGFCREETKSTNNASKLVQEAFMKHGFFLVKNHGVEAELIKHTHKYMREFFELPLVEKQRVQRKLGEHCGYASSFTTRFSCKLPWKETLSFPYSPEEANNTKVVEEYFNSKMTKDFAHMGKLYQEYCEAMNKLSLRIMELLGLSLGVGRQYFRDYFQGNDSVMRLNYYPPCQEPELALGTGPHCDPTSLTILHQDHVNGLQVFVDGEWRFIYPRFDTFVVNIGDTFMALSNGKYKSCLHRAVVNDTSPRKSLAFFLCPKEDLIVCPPNELVNESSPRVYPDFTWPIFLEFTQKHYRADMNTLLNFSRWVRERNQVQQSDGSSSVCPSIHLSCCNVQIK

SEQ ID NO: 2509 - protein, 381 aa, Ipomoea nil
  misc_feature (219)..(319): Pfam Name: 2OG-FeII_Oxy Pfam Description: 2OG-Fe(II) oxygenase superfamily
  misc_feature (1)..(381): Public GI ID no. 60498576
  misc_feature (1)..(381): Bit score of 822.9 for HMM based on sequences of Figure 31
  misc_feature (1)..(381): Functional Homolog Of SEQ ID NO. 2493
  misc_feature (1)..(381): in Figure 31
MAIECVTTTPTRSDDPKAAAVVFDSSVLRHETNIPTEFVWPEHEKPGSYAAPECPVPVIDLAAFRSGDPAAVAETLKLVNEACKKHGFFLVVNHGVDPDRISDAIRHMDRFFDLPLSSKEKALRKVGESCGYASSFTGRFSAKLPWKETLSFRYSAQKECSHIVEEYFQESLGQDFAHIGLVYQKYSNEMSKLALEIMEVLGMGLGVNRKHFSDFFQENDSVMRLNYCPPCQKPEITLGTGPHCDPTSLTILHQDNSVNGLQVCVDNEWRSVSPSPNAFVVNIGDTFMALSNGIYKSCLHRAVVNSTITRKSMAFFLCPHEDKVVTPPPELVDSTHPRLYPDFKWPTLLEFTQKHYRSDTDTLLSFSAWLQQNQTPHATHP

SEQ ID NO: 2510 - protein, 365 aa, Triticum aestivum
  misc_feature (200)..(299): Pfam Name: 2OG-FeII_Oxy Pfam Description: 2OG-Fe(II) oxygenase superfamily
  misc_feature (1)..(365): Public GI ID no. 75276875
  misc_feature (1)..(365): Bit score of 761.4 for HMM based on sequences of Figure 31
  misc_feature (1)..(365): Functional Homolog Of SEQ ID NO. 2493
  misc_feature (1)..(365): in Figure 31
MVQPVFDAAVLSGRADIPSQFIWPEGESPTPDAAEELHVPLIDIGGMLSGDPRATAEVTRLVGEACERHGFFQVVNHGIDAELLADAHRCVDAFFTMPLPEKQRALRRPGESCGYASSFTGRFASKLPWKETLSFRSCPSDPALVVDYIVATLGEDHRRLGEVYARYCSEMSRLSLEIMEVLGESLGVGRAHYRRFFEGNDSIMRLNYYPPCQRPMETLGTGPHCDPTSLTILHQDNVGGLQVHTEGRWRSIRPRADAFVVNIGDTFMALSNGRYKSCLHRAVVNSKVPRKSLAFFLCPEMDKVVAPPGTLVDAANPRAYPDFTWRSLLDFTQKHYRADMKTLEVFSSWIVQQQQGQLLPPLASH

SEQ ID NO: 2511 - DNA, 1267 bp, Arabidopsis thaliana
  misc_feature (1)..(1267): Ceres Clone ID no. 156575
  misc_feature (1)..(1267): Encodes the peptide sequence at SEQ ID NO. 2512
aatactactactcactttactataatctctcaaaatggccgtaagtttcgtaacaacatctcctgaggaagaagacaaaccgaagctaggccttggaaatattcaaactccgttaatcttcaacccttcaatgcttaaccttcaagccaatatcccaaaccaattcatctggcctgacgacgaaaaaccttccatcaacgttctcgagcttgatgttcctctcatcgaccttcaaaaccttctctctgatccatcctccactttagatgcttcgagactgatctctgaggcctgtaagaagcacggtttcttcctcgtggtcaatcacggcatcagcgaggagcttatatcagacgctcatgaatacacgagccgcttctttgatatgcctctctccgaaaaacagagggttcttagaaaatccggtgagagtgttggctacgcaagcagtttcaccggacgcttctccaccaagcttccatggaaggagaccctttctttccggttttgcgacgacatgagccgctcaaaatccgttcaagattacttctgcgatgcgttgggacatgggtttcagccatttgggaaggtgtatcaagagtattgtgaagcaatgagttctctatcactgaagatcatggagcttctcgggctaagtttaggcgtaaaacgggactactttagagagtttttcgaagaaaacgattcaataataagactgaattactaccctccatgtataaaaccagatctcacactaggaacaggacctcattgtgatccaacatctcttaccatccttcaccaagaccatgttaatggccttcaagtctttgtggaaaatcaatggcgctccattcgtcccaaccccaaggcctttgtggtcaatatcggcgatactttcatggctctatcgaacgatagatacaagagctgcttgcaccgggcggtggtgaacagcgagagcgagaggaagtcacttgcattcttcttgtgtccgaaaaaagacagagtagtgacgccaccgagagagcttttggacagcatcacatcaagaagataccctgacttcacatggtctatgttccttgagttcactcagaaacattatagagcagacatgaacactctccaagccttttcagattggctcaccaaacccatctaagaaataaaatattcatgtcttgtcttgttagttataactagtatcttctttatatttcatgtatgtatatggtaataggcaataacaccttttagcatc

SEQ ID NO: 2512 - protein, 377 aa, Arabidopsis thaliana
  misc_feature (223)..(322): Pfam Name: 2OG-FeII_Oxy Pfam Description: 2OG-Fe(II) oxygenase superfamily
  misc_feature (1)..(377): Ceres Clone ID no. 156575
  misc_feature (1)..(377): Bit score of 832.7 for HMM based on sequences of Figure 31
  misc_feature (1)..(377): Functional Homolog Of SEQ ID NO. 2493
MAVSFVTTSPEEEDKPKLGLGNIQTPLIFNPSMLNLQANIPNQFIWPDDEKPSINVLELDVPLIDLQNLLSDPSSTLDASRLISEACKKHGFFLVVNHGISEELISDAHEYTSRFFDMPLSEKQRVLRKSGESVGYASSFTGRFSTKLPWKETLSFRFCDDMSRSKSVQDYFCDALGHGFQPFGKVYQEYCEAMSSLSLKIMELLGLSLGVKRDYFREFFEENDSIIRLNYYPPCIKPDLTLGTGPHCDPTSLTILHQDHVNGLQVFVENQWRSIRPNPKAFVVNIGDTFMALSNDRYKSCLHRAVVNSESERKSLAFFLCPKKDRVVTPPRELLDSITSRRYPDFTWSMFLEFTQKHYRADMNTLQAFSDWLTKPI

SEQ ID NO: 2513 - protein, 377 aa, Arabidopsis thaliana
  misc_feature (223)..(322): Pfam Name: 2OG-FeII_Oxy Pfam Description: 2OG-Fe(II) oxygenase superfamily
  misc_feature (1)..(377): Public GI ID no. 9791186
  misc_feature (1)..(377): Bit score of 837.2 for HMM based on sequences of Figure 31
  misc_feature (1)..(377): Functional Homolog Of SEQ ID NO. 2493
MAVSFVTTSPEEEDKPKLGLGNIQTPLIFNPSMLNLQANIPNQFIWPDDEKPSINVLELDVPLIDLQNLLSDPSSTLDASRLISEACKKHGFFLVVNHGISEELISDAHEYTSRFFDMPLSEKQRVLRKSGESVGYASSFTGRFSTKLPWKETLSFRFCDDMSRSKSVQDYFCDALGHGFQPFGKVYQEYCEAMSSLSLKIMELLGLSLGVKRDYFREFFEENDSIMRLNYYPPCMKPDLTLGTGPHCDPTSLTILHQDHVNGLQVFVENQWRSIRPNPKAFVVNIGDTFMALSNDRYKSCLHRAVVNSKSERKSLAFFLCPKKDRVVTPPRELLDSITSRRYPDFTWSMFLEFTQKHYRADMNTLQAFSDWLTKPI

SEQ ID NO: 2514 - protein, 377 aa, Arabidopsis thaliana
  misc_feature (223)..(322): Pfam Name: 2OG-FeII_Oxy Pfam Description: 2OG-Fe(II) oxygenase superfamily
  misc_feature (1)..(377): Public GI ID no. 9791187
  misc_feature (1)..(377): Bit score of 816.9 for HMM based on sequences of Figure 31
  misc_feature (1)..(377): Functional Homolog Of SEQ ID NO. 2493
MAVSFVRTSPEEEDKPKLGLGNIQTPLIFNPSMLDLQANMANQFHWPDDEKPSTLQLELDVPLIDLQNLLSDPSSTLDASRLISEACKKHGFFLVVNHGISEELISDAHEYTSRFFDMPLSEKQRVLRKSGESVGYASSFTGRFSTKLPWKETLSFRFCDDMSRSKSVQDYFCDALGHGFQPFGKVYQEYCEAMSSLSLKIMELLGLSLGVKRDYFREFFEENDSIMRLNYYPPCIKPDLTLGTGPHCDPTSLTILHQDHVNGLQVFVENQWRSIRPNPKAFVVNIGDTFMALSNDRYKSCLHRAVVNSERMRKSLAFFLCPKKDRVVTPPRELLDSITSRRYPDFTWSMFLEFTQKHYRADMNTLQAFSDWLTKPI

SEQ ID NO: 2515 - protein, 378 aa, Arabidopsis thaliana
  misc_feature (221)..(320): Pfam Name: 2OG-FeII_Oxy Pfam Description: 2OG-Fe(II) oxygenase superfamily
  misc_feature (1)..(378): Public GI ID no. 15242189
  misc_feature (1)..(378): Bit score of 775.2 for HMM based on sequences of Figure 31
  misc_feature (1)..(378): Functional Homolog Of SEQ ID NO. 2493
MAILCTTTSPAEKEHEPKQDLEKDQTSPLIFNPSLLNLQSQIPNQFIWPDEEKPSIDIPELNVPFIDLSSQDSTLEAPRVIAEACTKHGFFLVVNHGVSESLIADAHRLMESFFDMPLAGKQKAQRKPGESCGYASSFTGRFSTKLPWKETLSFQFSNDNSGSRTVQDYFSDTLGQEFEQFGKVYQDYCEAMSSLSLKIMELLGLSLGVNRDYFRGFFEENDSIMRLNHYPPCQTPDLTLGTGPHCDPSSLTILHQDHVNGLQVFVDNQWQSIRPNPKAFVVNIGDTFMALSNGIFKSCLHRAVVNRESARKSMAFFLCPKKDKVVKPPSDILEKMKTRKYPDFTWSMFLEFTQKHYRADVNTLDSFSNWVITNNNPI

SEQ ID NO: 2516 - DNA, 1615 bp, Glycine max
  misc_feature (1)..(1615): Ceres Clone ID no. 1101515
  misc_feature (1)..(1615): Encodes the peptide sequence at SEQ ID NO. 2517
aactagcagccttggcttttctttcatcctctctctcgaacttatttatctctctctgtttctctgttttgctctgcttctcaaaacataaccttttattattatagtattttactattataaactaattttgcattgctaatgcaatggccatagagtgcataacaaatatacaatcaatgtctcaaccacaaaagcaccaccaagagcacaaagaagatgaagcaccattggtttttgatgcctcacttctcaggcaccaactcaacctaccaaaacagttcatttggcctgatgaggaaaagccatgcatgaatgtgcctgagcttggtgtccctctcattgacttgggggggttcctctctggtgaccctgttgcaacaatggaggctgcaaggatagttggtgaggcatgccaaaagcatggtttctttcttgtggtgaaccatgggattgatgccaagttaatctctaatgctcatagctacatggatgacttctttgaggttcctctgtctcagaaacagagggctcagaggaaaacaggggaacactgtggttatgctagtagcttcactggcaggttctcttcaaagcttccatggaaagagacactttcttttcagtactcggctgaggaaaattcatccactattgtcaaagactacttgtgcaacacattggagaaagagtttgagcaatttgggagggtttaccaggactattgtgatgccatgagcaatctttctttggggataatggaacttttgggaatgagtcttggagttggtaaagcatgttttagagagttctttgaagagaataactcaataatgaggctcaattactaccctccttgtcaaaagcctgacctcactttgggcactggacctcactgtgacccaacatctttgaccattcttcaccaagaccaagtgggaggcctccaagtttttgttgacaatgagtggcattccattagcccaaatttcaatgcttttgttgtcaacataggtgacaccttcatggctctttcaaatggaaggtacaagagttgcttgcatagggcagtggtgaacagcaagaccacaagaaaatctcttgctttctttttgtgtccaaaaggtgataaggtggttagtccaccaagtgaattggtggatgatttgacaccaaggatataccctgattttacatggcctatgctgcttgagtttactcagaaacattatagagctgacatgaaaacccttgaggcattcaccaactggcttcttcaacggaaaatgagctgaaatgaaattttcaagcacatatgaatggcatattatctattagcctttgatagtctcctatgaatgaatagtgacaagtgtcaagtggaagaagtgtaattgatggcggagaaaagggcagcagcaaaaaggcactgagttggaaaaattgaaagaaaattcatgttttcttcatgaattgagtgttgcacgagtagtgattggagtagtattgaacaaaacaagggaaatgagataaaaatatttataaggcgtcaatgagaaaaaatcgccagctaatttttgtaatttttctttggtgatatagaaaagttattatt

SEQ ID NO: 2517 - protein, 382 aa, Glycine max
  misc_feature (226)..(325): Pfam Name: 2OG-FeII_Oxy Pfam Description: 2OG-Fe(II) oxygenase superfamily
  misc_feature (1)..(382): Ceres Clone ID no. 1101515
  misc_feature (1)..(382): Bit score of 906.3 for HMM based on sequences of Figure 31
  misc_feature (1)..(382): Functional Homolog Of SEQ ID NO. 2493
MAIECITNIQSMSQPQKHHQEHKEDEAPLVFDASLLRHQLNLPKQFIWPDEEKPCMNVPELGVPLIDLGGFLSGDPVATMEAARIVGEACQKHGFFLVVNHGIDAKLISNAHSYMDDFFEVPLSQKQRAQRKTGEHCGYASSFTGRFSSKLPWKETLSFQYSAEENSSTIVKDYLCNTLEKEFEQFGRVYQDYCDAMSNLSLGIMELLGMSLGVGKACFREFFEENNSIMRLNYYPPCQKPDLTLGTGPHCDPTSLTILHQDQVGGLQVFVDNEWHSISPNFNAFVVNIGDTFMALSNGRYKSCLHRAVVNSKTTRKSLAFFLCPKGDKVVSPPSELVDDLTPRIYPDFTWPMLLEFTQKHYRADMKTLEAFTNWLLQRKMS

SEQ ID NO: 2518 - protein, 385 aa, Populus nigra
  misc_feature (229)..(328): Pfam Name: 2OG-FeII_Oxy Pfam Description: 2OG-Fe(II) oxygenase superfamily
  misc_feature (1)..(385): Public GI ID no. 28316358
  misc_feature (1)..(385): Bit score of 905.1 for HMM based on sequences of Figure 31
  misc_feature (1)..(385): Functional Homolog Of SEQ ID NO. 2493
MAIDCIKTMPSITTPHHHPKDQDQCKDDGKSFVFDAQVLRHQTNIPQQFIWPDHEKPNINAPELQVPLVDLGDFLSGNPVAAVEASRLVGEACQKHGFFLVVNHGVDKTLIAHAHNYMDTFFELPLSEKQKAQRKIGESCGYASSFTGRFSSKLPWKETLSFRYTAEKNSSKHIEEYFHNRMGEDFAEFGRVYQDYCEAMSTLSLGIMELLGMSLGVSREHFREFFNENDSIMRLNYYPPCQKPDLTLGTGPHCDPTSLTILHQDQVGGLQVFVDNEWRSISPNFDAFVVNIGDTFMALSNGIYKSCLHRAVVNSQTPRKSLAFFLCPKNDKMVTPPHELVDTCNPRIYPDFTWPMLLEFTQKHYRADMKTLEVFTNWLHQQSFS

SEQ ID NO: 2519 - protein, 385 aa, Populus tremula x Populus tremuloides
  misc_feature (229)..(328): Pfam Name: 2OG-FeII_Oxy Pfam Description: 2OG-Fe(II) oxygenase superfamily
  misc_feature (1)..(385): Public GI ID no. 9650811
  misc_feature (1)..(385): Bit score of 895.9 for HMM based on sequences of Figure 31
  misc_feature (1)..(385): Functional Homolog Of SEQ ID NO. 2493
MAIDCIKTMPSITTPHHHPKDQDQCKDDGKSFVFDAQVLRHQTNIPQQFIWPDNEKPNINAPELQVPLVDLGDFLSGNPVAAVEASRLVGEACKKHGFFLVVNHGVDKTLIAHAHNYVDTFFKLPLSEKQKAQRKIGESCGYASSFTGRFSSKLPWKETLSFRYKAEENSSKHIEEYFHNRMGEDFAEFGTVYQDYCEAMSTLSLGIMELLGMSLGVSREHFREFFNENDSIMRLNYYPPCQKPDLTLGTGPHCDPTSLTILHQDQVGGLQVFVDNEWRSINPNFDAFVVNIGDTFMALSNGIYKSCLHRAVVNSQTPRKSLAFFLCPKNDKMVTPPHELVDTCNPRIYPDFTWPMLLEFTQKHYRADMKTLEVFTNWLHQRSFS

SEQ ID NO: 2520 - protein, 385 aa, Populus tremula
  misc_feature (229)..(328): Pfam Name: 2OG-FeII_Oxy Pfam Description: 2OG-Fe(II) oxygenase superfamily
  misc_feature (1)..(385): Public GI ID no. 53139594
  misc_feature (1)..(385): Bit score of 896.4 for HMM based on sequences of Figure 31
  misc_feature (1)..(385): Functional Homolog Of SEQ ID NO. 2493
MAIDCIKTMPSITTPHHHPKDQDQCKDDGKSFVFDAQVLRHQTNIPQQFIWPDNEKPNINAPELQVPLVDLGDFLSGNPVAAVEASRLVGEACKKHGFFLVVNHGVDKTLIAHAHNYVDTFFKLPLSEKQKAQRKIGESCGYASSFTGRFSSKLPWKETLSFRYKAEENSSKHIEEYFHNRMGEDFAEFGTVYQDYCEAMSTLSLGIMELLGMSLGVSREHFREFFNENDSIMRLNYYPPCQKPDLTLGTGPHCDPTSLTILHQDQVGGLQVFVDNEWRSINPNFDAFVVNIGDTFMALSNGIYKSCLHRAVVNSQTPRKSLAFFLCPKNDKMVTPPHELVDTCNPRIYPDFTWPMLLEFTQKHYRADMKTLEVFTNWLHQRSLS

SEQ ID NO: 2521 - protein, 385 aa, Populus tomentosa
  misc_feature (229)..(328): Pfam Name: 2OG-FeII_Oxy Pfam Description: 2OG-Fe(II) oxygenase superfamily
  misc_feature (1)..(385): Public GI ID no. 40233167
  misc_feature (1)..(385): Bit score of 895.2 for HMM based on sequences of Figure 31
  misc_feature (1)..(385): Functional Homolog Of SEQ ID NO. 2493
MAIDCIKTMPSITTPQHHPKDQDQCKDDGKSFVFDAQILRHQTNIPQQFVWPDHEKPNINAPELQVPLVDLGDFLSGNPVAAVEASRLVGEACKKHGFFLVVNHGVDKTLIAHAHNYVDTFFKLPLSEKQKAQRKIGESCGYASSFTGRFSSKLPWKETLSFRYTAEENSSKHIEEYFHNRMGEDFAEFGTVYQDYCEAMSTLSLGIMELLGMSLGVSREHFREFFNENDSIMRLNYYPPCQKPDLTLGTGPHCDPTSLTILHQDQVGGLQVFVDNEWRSINPNFDAFVVNIGDTFMALSNGIYKSCLHRAVVNGQTPRKSLAFFLCPKNDKMVTPPHELVDTCNPRIYPDFTWPMLLEFTQKHYRADMKTLEVFTNWLHQRSFT

SEQ ID NO: 2522 - protein, 385 aa, Populus tremula
  misc_feature (229)..(328): Pfam Name: 2OG-FeII_Oxy Pfam Description: 2OG-Fe(II) oxygenase superfamily
  misc_feature (1)..(385): Public GI ID no. 53139616
  misc_feature (1)..(385): Bit score of 894.6 for HMM based on sequences of Figure 31
  misc_feature (1)..(385): Functional Homolog Of SEQ ID NO. 2493
MAIDCIKSMPSITTPHHHPKDQDQCKDDGKSFVFDAQVLRHQTNIPQQFIWPDHEKPNINAPELQVPLVDLGDFLSGNPVAAVEASRLVGEACKKHGFFLVVNHGVDKTLIAHAHNYVDTFFKFPLSEKQKAQRKIGESCGYASSFTGRFSSKLPWKETLSFRYKAEENSSKHIEEYFHNRMGEDFAEFGTVYQDYCEAMSTLSLGIMELLGMSLGVSREHFREFFNENDSIMRLNYYPPCQKPDLTLGTGPHCDPTSLTILHQDQVGGLQVFVDNEWRSINPNFDAFVVNIGDTFMALSNGIYKSCLHRAVVNSQTPRKSLAFFLCPKNDKMVTPPHELVDTCNPRIYPDFTWPMLLEFTQKHYRADMKTLEVFTNWLHQRSLS

SEQ ID NO: 2523 - protein, 385 aa, Populus tremula
  misc_feature (229)..(328): Pfam Name: 2OG-FeII_Oxy Pfam Description: 2OG-Fe(II) oxygenase superfamily
  misc_feature (1)..(385): Public GI ID no. 53139588
  misc_feature (1)..(385): Bit score of 894.1 for HMM based on sequences of Figure 31
  misc_feature (1)..(385): Functional Homolog Of SEQ ID NO. 2493
MAIDCIKTMPSITTPHHHPKDQDQCKDDGKSFVFDAQVLRHQTNIPQQFIWPDNEKPNINAPELQVPLVDLGDFLSGNPVAAVEASRLVGEACKKHGFFLVVNHGVDKTLIAHAHNYVDTFFKLPLSEKQKAQRKIGESCGYASSFTGRFSSKLPWKETLSFRYKAEENSPKHIEEYFHNRMGEDFAEFGTVYQDYCEAMSTLSLGIMELLGMSLGVSREHFREFFNENDSIMRLNYYPPCQKPDLTLGTGPHCDPTSLTILHQDQVGGLQVFVDNEWRSINPNFDAFVVNIGDTFMALSNGIYKSCLHRAVVNSQTPRKSLAFFLCPKNDKMVTPPHELVDTCNPRIYPDFTWPMLLEFTQKHYRADMKTLEVFTNWLHQRSFS

SEQ ID NO: 2524 - protein, 385 aa, Populus tremula
  misc_feature (229)..(328): Pfam Name: 2OG-FeII_Oxy Pfam Description: 2OG-Fe(II) oxygenase superfamily
  misc_feature (1)..(385): Public GI ID no. 53139592
  misc_feature (1)..(385): Bit score of 891.2 for HMM based on sequences of Figure 31
  misc_feature (1)..(385): Functional Homolog Of SEQ ID NO. 2493
MAIDCIKTMPSITTPHHHPKDQDQCKDDGKSFVFDAQVLRHQTNIPQQFIWPDNEKPNINAPELQVPLVDLGDFLSGNPVAAVEASRLVGEACKKHGFFLVVNHGVDKTLIAHAHNYVDTFFKLPLSEKQKAQRKIGESCGYASSFTGRFSSKLPWKETLSFRYKAEENSSKHIEEYFHNRMGEDFAEFGTVYQDYCEAISTLSLGIMELLGMSLGVSREHFREFFNENDSIMRLNYYPPCQKPDLTLGTGPHCDPTSLTILHQDQVGGLQVFVDNEWRSINPNFDAFVVNIGDTFMALSNGIYKSCLHRAVVNSQTPRKSLAFFLCPKNDKMITPPHELVDTCNPRIYPDFTWPMLLEFTQKHYRADMKTLEVFTNWLHQRSLS

SEQ ID NO: 2525 - protein, 373 aa, Fragaria x ananassa
  misc_feature (217)..(316): Pfam Name: 2OG-FeII_Oxy Pfam Description: 2OG-Fe(II) oxygenase superfamily
  misc_feature (1)..(373): Public GI ID no. 77632796
  misc_feature (1)..(373): Bit score of 854.8 for HMM based on sequences of Figure 31
  misc_feature (1)..(373): Functional Homolog Of SEQ ID NO. 2493
MAVGCMKTLSHHKEDDQKPLVFDASLLRYETDIPKQFIWPDDEKPCPNTRELQVPLIDLGDFLSGNPEAAMKASRLVGEACEKHGFFLVVNHRVKESLIADAHQYMDEFFGLPLSEKQRTQRKAGEHCGYASSFTGRFSSKLPWKETLSFSYTADQSSSNVVKDYLCNAMGEEFDEFGRVYQDYSEAMSTLSIGIMELLGMSLGVGRTHFKEFFGDNDSIMRLNYYPPCQKPDQTLGTGPHCDPTSLTILHQDQVGGPEVFVDEEWRSISPNLNAFVVNIGDAFMALSNGRYKSCLHRAVVNSKTPRKSLAFFLCPKDDKVVKPPRELIDSSYPRIYPDFTWPMLLEFTQKHYRADMKTLQAFTNWLQEQRSS

SEQ ID NO: 2526 - protein, 385 aa, Populus alba
  misc_feature (229)..(328): Pfam Name: 2OG-FeII_Oxy Pfam Description: 2OG-Fe(II) oxygenase superfamily
  misc_feature (1)..(385): Public GI ID no. 34013374
  misc_feature (1)..(385): Bit score of 895.4 for HMM based on sequences of Figure 31
  misc_feature (1)..(385): Functional Homolog Of SEQ ID NO. 2493
MAIDCIKTMPSITTPHHHPKDQDQCKDDGKSFVFDAQVLRHQTNIPQQFIWPDHEKPNTNAPELQVPLVDLGDFLSGNPVAAVEASRLVGEACKKHGFFLVVNHGVDKTLIAHAHNYVDTFFKLPLSEKQKAQRKIGESCGYASSFTGRFSSKLPWKETLSFRYKAEESSSKHIEEYFHNRMGEDFAEFGTVYQDYCEAMSTLSLGIMELLGMSLGVSREHFREFFNENDSIMRLNYYPPCQKPDLTLGTGPHCDPTSLTILHQDQVGGLQVFVDNEWRSINPNFDAFVVNIGDTFMALSNGIYRSCLHRAVVNSQTPRKSLAFFLCPKNDKMVTPPHELVDTCNPRIYPDFTWPMLLEFTQKHYRADMKTLEVFTNWLHQRSLS

SEQ ID NO: 2527 - protein, 385 aa, Populus tremula
  misc_feature (229)..(328): Pfam Name: 2OG-FeII_Oxy Pfam Description: 2OG-Fe(II) oxygenase superfamily
  misc_feature (1)..(385): Public GI ID no. 53139654
  misc_feature (1)..(385): Bit score of 895.6 for HMM based on sequences of Figure 31
  misc_feature (1)..(385): Functional Homolog Of SEQ ID NO. 2493
MAIDCIKTMPSITTPHHHPKDQDQCKDDGKSFVFDAQVLRHQTNIPQQFIWPDHEKPNINAPELQVPLVDLGDFLSGNPVAAVEASRLVGEACKKHGFFLVVNHGVDKTLIAHAHNYVDTFFKLPLSEKQKAQRKIGESCGYASSFTGRFSSKLPWKETLSFRYKAEENSPKHIEEYFHNRMGEDFAEFGTVYQDYCEAMSTLSLGIMELLGMSLGVSREHFREFFNENDSIMRLNYYPPCQKPDLTLGTGPHCDPTSLTILHQDQVGGLQVFVDNEWRSINPNFDAFVVNIGDTFMALSNGIYKSCLHRAVVNSQTPRKSLAFFLCPKNDKMVTPPHELVDTCNPRIYPDFTWPMLLEFTQKHYRADMKTLEVFTNWLHQRSFS

SEQ ID NO: 2528 - protein, 385 aa, Phaseolus vulgaris
  misc_feature (224)..(323): Pfam Name: 2OG-FeII_Oxy Pfam Description: 2OG-Fe(II) oxygenase superfamily
  misc_feature (1)..(385): Public GI ID no. 2108432
  misc_feature (1)..(385): Bit score of 850.5 for HMM based on sequences of Figure 31
  misc_feature (1)..(385): Functional Homolog Of SEQ ID NO. 2493
MAIDMHPIPIMPQPSNQEIKEQDQHPLVFDASLLRHQLHIPSQFVWPDEEKACLNEPELPVPFIDLGGFLSGDPLAATEASRLVGEACQKHGFFLVVNHGIQQQLISDAHLYMDHFFALPLSHKQRAQRMPGEHCGYASSFTGRFSSKLPWKETLSFQYSPRNDSQTLVKDYLCDKMGKEFEKFGNVYQDYCEAMSNLSLGIMELLGLSLGVGRGYFREFFEENNSIMRLNYYPPCQKPDLTLGTGPHCDPTSLTILHQDQVGGLQVCVDNEWHSIKPDVNAFVVNVGDTFMALSNGRYKSCLHRAVVNSETTRKSLAFFLCPRSDKVVSPPCELVDKLSPRLYPDFTWPMLLEFTQKHYRADMKTLEAFTNWLQRRSNFDNHIM

SEQ ID NO: 2529 - protein, 385 aa, Populus tremula
  misc_feature (229)..(328): Pfam Name: 2OG-FeII_Oxy Pfam Description: 2OG-Fe(II) oxygenase superfamily
  misc_feature (1)..(385): Public GI ID no. 53139590
  misc_feature (1)..(385): Bit score of 890.8 for HMM based on sequences of Figure 31
  misc_feature (1)..(385): Functional Homolog Of SEQ ID NO. 2493
MAIDCIKTMPSITTPHHHPKDQDQCKDDGKSFVFDAQVLRHQTNIPQQFIWPDNEKPNINAPELQVPLVDLGDFLSGNPVAAVEASRLVGEACKKHGFFLVVNHGVDKTLIAHAHNYVDTFFKLPLSEKQKAQRKIGESCGYASSFTGRFSSKLPWKETLSFRYQAEENSPKHIEEYFHNRMGEDFAEFGTVYQDYCEAMSTLSLGIMELLGMSLGVSREHFREFFNENDSIMRLNYYPPCQKPDLTLGTGPHCDPTSLTILHQDQVGGLQVFVDNEWRSINPNFDAFVVNIGDTFMALSNGIYKSCLHRAVVNSQTPRKSLAFFLCPKNDKMVTPPHELVDTCNPRIYPDFTWPMLLEFTQEHYRADMKTLEVFTNWLHQRSFS

SEQ ID NO: 2530 - protein, 382 aa, Acacia mangium
  misc_feature (227)..(326): Pfam Name: 2OG-FeII_Oxy Pfam Description: 2OG-Fe(II) oxygenase superfamily
  misc_feature (1)..(382): Public GI ID no. 160623445
  misc_feature (1)..(382): Bit score of 881.3 for HMM based on sequences of Figure 31
  misc_feature (1)..(382): Functional Homolog Of SEQ ID NO. 2493
MVVECITNNLPSMPHPAKHGTKEDKEDEPLVFDASLLRYEHNLPKQFIWPDEEKPCLNPPELVVPLVDLRGFLSGDPVAAMETSKLVSEACRKHGFFLVVNHRIDSRLISHAHRFMDDFFELPLSQKQRAQRKAGEHCGYASSFTSRFSSKLPWKETLSFQFSADKNSQNLVKDYLCEKVGHEFEQFGMVYQEYCEAMSNLSLVIMELLGMSLGVGRTCFREFFDKNNSIMRLNYYPPCQKPDLTLGTGPHCDPTSLTILHQDKVGGLQVYVDNEWHSITPNFNAFVVNIGDTFMALSNGRYKSCLHRAVVNSQTTRKSLAFFLCPGDDKVVTPPSELVDHVSPRIYPDFTWPMLLEFTQKHYRADMNTLEQFANWVQRNKS

SEQ ID NO: 2531 - protein, 385 aa, Populus tremula
  misc_feature (229)..(328): Pfam Name: 2OG-FeII_Oxy Pfam Description: 2OG-Fe(II) oxygenase superfamily
  misc_feature (1)..(385): Public GI ID no. 53139610
  misc_feature (1)..(385): Bit score of 890.1 for HMM based on sequences of Figure 31
  misc_feature (1)..(385): Functional Homolog Of SEQ ID NO. 2493
MAIDCIKTMPSITTPHHHPKDQDQCKDDGKSFVFDAQVLRHQTNIPQQFIWPDNEKPNINAPELQVPLVDLGDFLSGNPVAAVEASRLVGEACKKHGFFLVVNHGVDKTPIAHAHNYVDTFFKLPLSEKQKAQRKIGESCGYASSFTGRFSSKLPWKETLSFRYKAEENSPKHIEEYFHNRMGEDFAEFGTVYQDYCEAMSTLSLGIMELLGMSLGVSREHFREFFNENDSIMRLNYYPPCQKPDLTLGTGPHCDPTSLTILHQDQVGGLQVFVDNEWRSINPNFDAFVVNIGDTFMALSNGIYKSCLHRAVVNSQTPRKSLAFFLCPKNDKMVTPPHELVDTCNPRIYPDFTWPMLLEFTQKHYRADMKTLEVFTNWLHQRSFS

SEQ ID NO: 2532 - DNA, 1622 bp, Gossypium hirsutum
  misc_feature (1)..(1622): Ceres Clone ID no. 1842451
  misc_feature (1)..(1622): Encodes the peptide sequence at SEQ ID NO. 2533
atccatctttgttaggcctcagcatatttacgcttcatgcaatggccatcgactgcatctccaacatagcctccatgactcaccatccgaaagatgaaaaaaaagatgagcagaaaaagctggtttttgatgcctcggtgctcaagttcgaatcccagataccaaaagaatttatatggcctgatgacgaaaagccttccgctaatgcaccagaactccaagtaccactcattgacctaggaggcttcctttctggtgaccctgttgctacaatggaagcttcaaggtttatcagcgaggcatgtcagcagcatggtttcttccttgtagttaatcatggagtcgatgcaaaactcttggctgatgcccacaagtacatggataacttctttctattgccacttagacaaaagcaaagggctcaaagaaaacttggtgagcactgtggatatgccagtagcttcactggcaggttctcgaccaagctcccatggaaggaaacactttcttttcgctattcagccgagaacaactcatccaagatggtggaagactaccttgttaataaaatgggaaatgaattgaggcaactcgggagggtttaccaggactactgcgaggcgatgagcaagctttctctggggataatggagcttttagccattagtctgggcgtaggcagagcacatttccgggagttttttgataaaaatgattcaataatgagactaaactactatcccccttgtcaaaaaccagacctcactttaggaacagggcctcattgcgatccaacgtctttaaccatccttcaccaagacagagttggtggccttcaagtgtttgtagacaacgaatggcattcaattagcccaaatttcgaagcatttgtcgttaacattggcgacacctttatggcactgtcaaatgggagatataaaagttgcttgcaccaagcagtggtgaacagccataagccaagaaaatctctggctttctttttgtgtccagagggggataaagtggtaaccccaccagcagagttggtgagccagaacagtcccagagtatatccagattttacatggcctatgctgcttgaattcacacaaaagcattacagagctgacatgaacactcttcaagaattctcaaactgggttcaacagagaaacagctgaggcggtcttgtctctctctactgtctagttaaggtgtcgtcacaaaatacaaacaaaccttggcatatcactcagtcactaccctacgacaatgaattaattgaagagattggatgggtttttttgctaccagttagaaggaataaccaaaaagcaaagaaatgcccccttttttgtttcatgttcatgatgtcagagtgataacaagcttgttagtgatgaacaaatggcaagacaagagatacaaataaggaaccgcataaagagcttgattaggttttcttttttctaattttgcatcttcattgatgatacaagaaaggcaatccatagattcacctctcttcttcatgtaaaaacaaaattagggtacttgttaattagtaccatcttttttttgaagtaatttcatgcattaccaaagtgattttatattttatc

SEQ ID NO: 2533 - protein, 379 aa, Gossypium hirsutum
  misc_feature (224)..(323): Pfam Name: 2OG-FeII_Oxy Pfam Description: 2OG-Fe(II) oxygenase superfamily
  misc_feature (1)..(379): Ceres Clone ID no. 1842451
  misc_feature (1)..(379): Bit score of 885.4 for HMM based on sequences of Figure 31
  misc_feature (1)..(379): Functional Homolog Of SEQ ID NO. 2493
MAIDCISNIASMTHHPKDEKKDEQKKLVFDASVLKFESQIPKEFIWPDDEKPSANAPELQVPLIDLGGFLSGDPVATMEASRFISEACQQHGFFLVVNHGVDAKLLADAHKYMDNFFLLPLRQKQRAQRKLGEHCGYASSFTGRFSTKLPWKETLSFRYSAENNSSKMVEDYLVNKMGNELRQLGRVYQDYCEAMSKLSLGIMELLAISLGVGRAHFREFFDKNDSIMRLNYYPPCQKPDLTLGTGPHCDPTSLTILHQDRVGGLQVFVDNEWHSISPNFEAFVVNIGDTFMALSNGRYKSCLHQAVVNSHKPRKSLAFFLCPEGDKVVTPPAELVSQNSPRVYPDFTWPMLLEFTQKHYRADMNTLQEFSNWVQQRNS

SEQ ID NO: 2534 - protein, 385 aa, Populus tremula
  misc_feature (229)..(328): Pfam Name: 2OG-FeII_Oxy Pfam Description: 2OG-Fe(II) oxygenase superfamily
  misc_feature (1)..(385): Public GI ID no. 53139612
  misc_feature (1)..(385): Bit score of 888.5 for HMM based on sequences of Figure 31
  misc_feature (1)..(385): Functional Homolog Of SEQ ID NO. 2493
MAIDCIKTMPSITTPHHHPKDQDQCKDDGKSFVFDAQVLRHQTNIPQQFIWPDNEKPNINAPELQVPLVDLGDFLSGNPVAAVEASRLVGEACKKHGFFLVVNHGVDKTLIAHAHNYVDTFFKLPLSEKQKAQRKIGESCGYASSFTGRFSSKLPWKETLSFRYKAEENSPKHIEEYFHNRMGEDFAEFGTVYQDYCEAMSTSSLGIMELLGMSLGVSREHFREFFNENDSIMRLNYYPPCQKPDLTLGTGPHCDPTSLTILHQDQVGGLQVFVDNEWRSINPNFDAFVVNIGDTFMALSNGIYKSCLHRAVVNSQTPRKSLAFFLCPENDKMVTPPHELVDTCNPRIYPDFTWPMLLEFTQKHYRADMKTLEVFTNWLHQRSFS

SEQ ID NO: 2535 - protein, 383 aa, Lactuca sativa
  misc_feature (226)..(325): Pfam Name: 2OG-FeII_Oxy Pfam Description: 2OG-Fe(II) oxygenase superfamily
  misc_feature (1)..(383): Public GI ID no. 4164141
  misc_feature (1)..(383): Bit score of 891.7 for HMM based on sequences of Figure 31
  misc_feature (1)..(383): Functional Homolog Of SEQ ID NO. 2493
MAIDCMIKTPSCMSSLKEELKEDQQRSLVFDASVLQHETNIPQQFIWPDNEKPNSKKSKDLEVPLIDLGGFLSGRSSSTKEASKLVGNACQKHGFFLVVNHGVDANLISDAQTYMDLFFELPLSEKQRAQRKAGESCGYASSFTGRFSSKLPWKETLSFRFSAEKNSADIVKDYFENTMGEEFVRLGKVYQEYCNAMSRLSLGIMELLGLSLGVNRSHFKEFFEENNSIMRLNYYPRCQKPELTLGTGPHCDPTSLTILHQDNVGGLEVFVDNEWRSITPNSNAFVVNIGDTFMALSNGRYKSCLHRAVVNNKTPRKSLAFFLCPKKDKVVSPPKELVDENNPRVYPDFTWATFLEFTQKHYRADMNTLQAFSNWVEQKTSTT

SEQ ID NO: 2536 - protein, 379 aa, Nicotiana tabacum
  misc_feature (222)..(321): Pfam Name: 2OG-FeII_Oxy Pfam Description: 2OG-Fe(II) oxygenase superfamily
  misc_feature (1)..(379): Public GI ID no. 3327245
  misc_feature (1)..(379): Bit score of 899.0 for HMM based on sequences of Figure 31
  misc_feature (1)..(379): Functional Homolog Of SEQ ID NO. 2493
MAIDCMITNVKSPILRILEDEKKPLIFDASQMKREYNIPTQFVWPDDEKPRAVARELPVPLIDLGGFLSGDPVAAQQASRLVGEACRNHGFFLVVNHGVNANLISNAHRYMDMFFDLPLSEKQKAQRKLEEHCGYASSFTGRFSSKLPWKETLSFRYSAEEDSSHIVEEYFQNTMGESFSHLGNVYQEYCNSMSTLSLGIMELLGMSLGVGREHFKEFFEENESIMRLNYYPPCQKPDLTLGTGPHCDPTSLTILHQDSVGGLQVFVDNEWRSISPNFNAFVVNIGDTFMALSNGRYKSCLHRAVVNNKTPRKSLAFFLCPKKDKVVSPPTELVDTNNPRIYPDFTWPTLLEFTQKHYRADMNTLQTFSNWLQQKTAQV

SEQ ID NO: 2537 - DNA, 1370 bp, Glycine max
  misc_feature (1)..(1370): Ceres Clone ID no. 624633
  misc_feature (1)..(1370): Encodes the peptide sequence at SEQ ID NO. 2538
aacaagcggccttggcttttctttcatctcttctaccaacctattcttattattatttcactctccctctcttcctcgttacaacaacaacaacaacaacaacttcattctctgcctcttctctccactctcttaaccaacaaacaaccttgtattattattaatatataattaatgcaatggcaatagactgcataacaagcatacccatgatgcctcaaccaccaacccaagaaacaaccaaagaacaagaacagcagcagccactggtgtttgatgcctcagtcctcagacaccaacttcacataccctcacaattcatctggcccgatgaagaaaaagcatgcttggacgaacccgagttgtttgtcccattcattgacttgggagggttcctctctggtgacccagttgctgcaacggaagcctcgaggcttgctggtgaagcatgccaaaagcatggtttttttctggttgtgaatcatgggattgatcaacggttgatatgtgatgctcatctttacatggagcacttctttgggcttcccctgtctcagaaacagagggctcagaggaagccaggggagcactgtggctatgctagtagcttcactggaaggttctcctctaagctcccttggaaagagacactttcctttcagtactcagctgacaaaaactcatcaccagcccttgtcaaagattacttgtgcagtaaaatgggcaaagagtttgagcaatttgggaaggtttaccaggactactgtgatgccatgagcaatctttctttaggtataatggagcttctaggaatgagccttggagttggtagagcctgctttagggagttctttgaagagaatagttcaataatgaggctgaattactaccctccgtgtcaaaagcctgacctcactttaggcactggacctcattgtgatccaacatctttgaccattcttcaccaggaccaagtgggaggcttgcaagtttgtgttgacaatgagtggcattccattaagccggatctcaatgcttttgttgtcaatgttggtgataccttcatggctctttcgaatgggagatacaagagttgcttgcatagggcagtggtgaatagccagacaacaagaaaatctcttgctttctttttgtgtccaagaagtgacaaggtggtaagtccaccatgtgaattagtggacaatttgagcccaaggctatacccagattttacatggcccatgctgctggagttcactcaaaagcattacagagctgacatgaaaacccttgaggcatttgccaactggctccggaaaagtaactgaaatttcaagaagcacatcaagggcccttgatctacccaaaac

SEQ ID NO: 2538 - protein, 382 aa, Glycine max
  misc_feature (228)..(327): Pfam Name: 2OG-FeII_Oxy Pfam Description: 2OG-Fe(II) oxygenase superfamily
  misc_feature (1)..(382): Ceres Clone ID no. 624633
  misc_feature (1)..(382): Bit score of 858.3 for HMM based on sequences of Figure 31
  misc_feature (1)..(382): Functional Homolog Of SEQ ID NO. 2493
MAIDCITSIPMMPQPPTQETTKEQEQQQPLVFDASVLRHQLHIPSQFIWPDEEKACLDEPELFVPFIDLGGFLSGDPVAATEASRLAGEACQKHGFFLVVNHGIDQRLICDAHLYMEHFFGLPLSQKQRAQRKPGEHCGYASSFTGRFSSKLPWKETLSFQYSADKNSSPALVKDYLCSKMGKEFEQFGKVYQDYCDAMSNLSLGIMELLGMSLGVGRACFREFFEENSSIMRLNYYPPCQKPDLTLGTGPHCDPTSLTILHQDQVGGLQVCVDNEWHSIKPDLNAFVVNVGDTFMALSNGRYKSCLHRAVVNSQTTRKSLAFFLCPRSDKVVSPPCELVDNLSPRLYPDFTWPMLLEFTQKHYRADMKTLEAFANWLRKSN

SEQ ID NO: 2539 - protein, 370 aa, Kalanchoe blossfeldiana
  misc_feature (211)..(310): Pfam Name: 2OG-FeII_Oxy Pfam Description: 2OG-Fe(II) oxygenase superfamily
  misc_feature (1)..(370): Public GI ID no. 158392463
  misc_feature (1)..(370): Bit score of 829.6 for HMM based on sequences of Figure 31
  misc_feature (1)..(370): Functional Homolog Of SEQ ID NO. 2493
MAIEKQLQGEQTPLVFDASVLSHQTQIPKQFIWPDEEKPLPNLRELPVPLLDLNGFLAHDAAATNEAAKLVGEACEKHGFFLVVNHGVDAKLLADAHKYMDHFFDLPLAEKQRAQRKVGEHCGYASSFTGRFSSKLPWKETLSFRFSAEENKADIVREYFKSTMGEDFEHLGRVYQHYCKAMSRLSLGIMELLGMSLGVGRDYFRDFFEENDSIMRLNYYPPCQKPDQTLGTGPHCDPTSLTILHQDQVGGLQVFADNEWWSISPMADAFVVNIGDTFMALSNGRYKSCLHRAVVNSQSPRKSLAFFLSPKGDRVVSPPNQLVNPTVPRIYPDFTWPKLLEFTQKHYRADMNTLDAFSSWIQGHVLQYHT

SEQ ID NO: 2540 - protein, 379 aa, Nicotiana tabacum
  misc_feature (222)..(321): Pfam Name: 2OG-FeII_Oxy Pfam Description: 2OG-Fe(II) oxygenase superfamily
  misc_feature (1)..(379): Public GI ID no. 3402332
  misc_feature (1)..(379): Bit score of 891.9 for HMM based on sequences of Figure 31
  misc_feature (1)..(379): Functional Homolog Of SEQ ID NO. 2493
MAIDCMITNVNSPMLRILEDDKKPLIFDASQMKREYNIPTQFIWPDDEKPRAVARELPVPLIDLGGFLSGDPVAAQQASRLVGEACRNHGFFLVVNHGVNANLISNAHRYMDMFFDLPLSEKQKAQRKLEEHCGYASSFTGRFSSKLPWKETLSFRYSAEEDSSHIVEEYFQNTMGESFSHLGNVYQEYCNSMSTLSLGIMELLGMSLGVGREHFKEFFEENESIMRLNYYPPCQKPDLTLGTGPHCDPTSLTILHQDSVGGLQVFVDNEWRSVSPNFNAFVVNIGDTFMALSNGRYKSCLHRAVVNNKTPRKSLAFFLVPKKDKVVSPPNELVDTNNPRIYPDFTWPTLLEFTQKHYRADMNTLQTFSNWLKQKTAQV

SEQ ID NO: 2541 - protein, 377 aa, Chrysanthemum x morifolium
  misc_feature (222)..(321): Pfam Name: 2OG-FeII_Oxy Pfam Description: 2OG-Fe(II) oxygenase superfamily
  misc_feature (1)..(377): Public GI ID no. 169403818
  misc_feature (1)..(377): Bit score of 877.6 for HMM based on sequences of Figure 31
  misc_feature (1)..(377): Functional Homolog Of SEQ ID NO. 2493
MAIDCMIKTTSNMPSLKEDQRKSFVFDASVLKHETNIPQQFIWPDHEKPNSQKSKELEVPLIDLGGFLSGRSSSANDASSLVGEACQKHGFFLVVNHGVDANLISDAQRYMDLFFELPLSVKQRAQRKVGESCGYASSFTGRFSSKLPWKETLSFRFSAEENASNIVKDYFENTMGEEFIRLGKVYQEYCNAMSRLSLGIMELLGMSLGVSRAYYKDFFEEHNSIMRLNYYPPCQKPDLTLGTGPHCDPTSLTILHQDNVGGLEVFVDNEWRLIVPNSNAFVVNIGDTFMALSNGRYKSCLHRAVVNSKTTRKSLAFFLCPKKDKVVIPPKELVDENNPRIYPDFTWSTFLEFTQKHYRADKNTLQAFSTWVRQKTT

SEQ ID NO: 2542 - protein, 378 aa, Cucurbita maxima
  misc_feature (214)..(313): Pfam Name: 2OG-FeII_Oxy Pfam Description: 2OG-Fe(II) oxygenase superfamily
  misc_feature (1)..(378): Public GI ID no. 27124556
  misc_feature (1)..(378): Bit score of 821.4 for HMM based on sequences of Figure 31
  misc_feature (1)..(378): Functional Homolog Of SEQ ID NO. 2493
MHVVTSTPEARHDGAPLVFDASVLRHQHNIPKQFIWPDEEKPAATCPELEVPLIDLSGFLSGEKDAAAEAVRLVGEACEKHGFFLVVNHGVDRKLIGEAHKYMDEFFELPLSQKQSAQRKAGEHCGYASSFTGRFSSKLPWKETLSFRFAADESLNNLVLHYLNDKLGDQFAKFGRVYQDYCEAMSGLSLGIMELLGKSLGVEEQCFKNFFKDNDSIMRLNFYPPCQKPHLTLGTGPHCDPTSLTILHQDQVGGLQVFVDNQWRLITPNFDAFVVNIGDTFMALSNGRYKSCLHRAVVNSERTRKSLAFFLCPRNDKVVRPPRELVDTQNPRRYPDFTWSMLLRFTQTHYRADMKTLEAFSAWLQQEQQEQQEQQFNI

SEQ ID NO: 2543 - DNA, 1101 bp, Populus balsamifera subsp. trichocarpa
  misc_feature (1)..(1101): Ceres Annot ID no. 1497117
  misc_feature (1)..(1101): Encodes the peptide sequence at SEQ ID NO. 2544
atggtaatgcctcctactcttcctcctcctcgacagccattagtatttgatgcttcaattcttcaacaccaagccaatataccctctcagttcatttggcctgaccacgaaaaaccatgccttgaatccccaaaacttgcaatcccccctattgattttggaagcttcctcactggagatcctttggcagtctcaaaagctactcagctagtaaatgaggcatgcaagaagcatggattctttctagttgttaaccatggagttgattcaaagcttatagctaaagctcatgagtatatgaacatgttttttggcatacaactctcagagaagcaaagagctcaaagaaagataggagagcaatatgggtatgctagtagcttcactggaagattctcctccaaacttccatggaaagaaacactttctttccgatattgtgctgacaatcagtcttctgacatcgtccaagaatacttcttgaatgtaatgggagaaaatttcaaacaattcgggaaggtttaccaagaatattgtgaagccatgaacactctttctcttggaattatggagctattaggagtaagtctaggagttggaagagaatattttagagatttcttcgaaggaaacgattcgataatgagactgaattactaccctccttgccaaaagccggatttaactcttggcactgggcctcattgtgatcccacatccttaacaatcctccatcaagatcatgtcggtggccttcaagtgttcgtcgatgaaaaatggcactccgtcagtcctgatccggaagctttcgtcgtcaacatcggtgacacattcacggctctatcaaatggcattttcaagagttgcttgcatagagcggtggtaaataatgtaacagtaaggaaatcccttgctttctttctctgtccaaaactggataaggtggtgaagccaccaaataccttgatcgactctaagaatccgagggtatatccggacttcacatggccaactttgtcagaattcacacagaaacattatagggccgacatgaaaaccctagatgtcttcacaacctggcttcaacaaaaaaacaattag

SEQ ID NO: 2544 - protein, 366 aa, Populus balsamifera subsp. trichocarpa
  misc_feature (211)..(310): Pfam Name: 2OG-FeII_Oxy Pfam Description: 2OG-Fe(II) oxygenase superfamily
  misc_feature (1)..(366): Ceres Annot ID no. 1497117
  misc_feature (1)..(366): Bit score of 794.6 for HMM based on sequences of Figure 31
  misc_feature (1)..(366): Functional Homolog Of SEQ ID NO. 2493
MVMPPTLPPPRQPLVFDASILQHQANIPSQFIWPDHEKPCLESPKLAIPPIDFGSFLTGDPLAVSKATQLVNEACKKHGFFLVVNHGVDSKLIAKAHEYMNMFFGIQLSEKQRAQRKIGEQYGYASSFTGRFSSKLPWKETLSFRYCADNQSSDIVQEYFLNVMGENFKQFGKVYQEYCEAMNTLSLGIMELLGVSLGVGREYFRDFFEGNDSIMRLNYYPPCQKPDLTLGTGPHCDPTSLTILHQDHVGGLQVFVDEKWHSVSPDPEAFVVNIGDTFTALSNGIFKSCLHRAVVNNVTVRKSLAFFLCPKLDKVVKPPNTLIDSKNPRVYPDFTWPTLSEFTQKHYRADMKTLDVFTTWLQQKNN

SEQ ID NO: 2545 - protein, 390 aa, Chrysanthemum x morifolium
  misc_feature (235)..(334): Pfam Name: 2OG-FeII_Oxy Pfam Description: 2OG-Fe(II) oxygenase superfamily
  misc_feature (1)..(390): Public GI ID no. 190192208
  misc_feature (1)..(390): Bit score of 874.3 for HMM based on sequences of Figure 31
  misc_feature (1)..(390): Functional Homolog Of SEQ ID NO. 2493
MLTLLTLKNIICAMAIDCMIKTTSNMPSLKEDQRKSFVFDASVLKHETNLPQQFIWPDHEKPNSQKSKELEVPLIDLGGFLSGRSSSTKEASSLVGEACQKHGFFLVVNHGVDANLISDAQRYMDLFFELPLSVKQRAQRNVGESCGYASSFTGRFSSKLPWKETLSFRFSAEENASNIVKEYFENTMGEEFIRLGKVYQEYCNAMSRLSLGIMELLGMSLGVSRAYYKEFFEEHNSIMRLNYYPPCQKPDLTLGTGPHCDPTSLTILHQDNVGGLEVFVDNEWRLIVPNSNAFVVNIGDTFMALSNGRYKSCLHRAVVNSKTTRKSLAFFLCPKKDKVVIPPKELVDENNPRIYPDFTWSTFLEFTQKHYRADKNTLQAFSTWVRQKTT

SEQ ID NO: 2546 - protein, 392 aa, Malus x domestica
  misc_feature (234)..(333): Pfam Name: 2OG-FeII_Oxy Pfam Description: 2OG-Fe(II) oxygenase superfamily
  misc_feature (1)..(392): Public GI ID no. 12231168
  misc_feature (1)..(392): Bit score of 830.8 for HMM based on sequences of Figure 31
  misc_feature (1)..(392): Functional Homolog Of SEQ ID NO. 2493
MAVECMIKPSSLQTMTQPPSPKTQQTQQHKEDDQKPLVFDASVFRYQTEIPSQFIWPDHEKPCKNTPELQVALIDLGGFLSGDKEAVAKASQLVGEACQKHGFFLIVNHGVDNKLIADAHCYMDDFFGMPLSEKQRAERKAGESCGYASSFTGRFSSKLPWKETLSFSYSAEKGSTNFIQDYFCDKMGEEFKEFGRVYQDYCKAMSTLSIGIMELLGLSLGVDRAYFKEFFEDNNSIMRLNYYPPCQRPEQTLGTGPHCDPTALTILHEDQVGGLEVFVDDQWHSVTPNLNAFVVNIGDTFMALSNGKYKSGLHRAVVNSETPRKSLAFFLCPRDDKVVKPPSGLVDTSSPRKYPDFTWSMLLEFTMKHYRADMKTLQVFSNWVQQKSNQKL

SEQ ID NO: 2547 - protein, 389 aa, Beta vulgaris
  misc_feature (227)..(326): Pfam Name: 2OG-FeII_Oxy Pfam Description: 2OG-Fe(II) oxygenase superfamily
  misc_feature (1)..(389): Public GI ID no. 21322508
  misc_feature (1)..(389): Bit score of 827.6 for HMM based on sequences of Figure 31
  misc_feature (1)..(389): Functional Homolog Of SEQ ID NO. 2493
MAIDCMRNLSSTPKSYQNSKQEQNNPLIFDASFLNHQSHIPQQFIWPDGEKPDFIEPEELAVPLIDLQGFLSDDPEKTLKASKLIGEACLKHGFFLVVNHGVERDLIKDAHNLMDDFFEEPLSLKQKALRKLGEHCGYASSFTGRFSCNLPWKETLSFNYSPQESSSSKTHVQDYFNNKFGDSFNHLGTTYQQYCEAMSTLSLRIMELLGLSLGVGRRHFREFFEGHESVMRLNYYPPCQRPDLTLGTGPHCDPTSLTILHQDQVGGLQVFADGKWRSISPNFNAFVVNIGDTFMALSNGRYKSCLHRAVVNSEKPRKSLAFFLCPNKDKVVKPPRELVDEENNPRVYPDFTWPLLLEFTQKHYRADMNTLKVFSQWVQQQRSTQQVEK

SEQ ID NO: 2548 - protein, 376 aa, Nerium oleander
  misc_feature (221)..(320): Pfam Name: 2OG-FeII_Oxy Pfam Description: 2OG-Fe(II) oxygenase superfamily
  misc_feature (1)..(376): Public GI ID no. 51011360
  misc_feature (1)..(376): Bit score of 868.0 for HMM based on sequences of Figure 31
  misc_feature (1)..(376): Functional Homolog Of SEQ ID NO. 2493
MAIDCMFKSKSTVPEMCKDEKKPLVFDASLLQHQTHIPTEFIWPEHEKPCPNPREHPVPLIDLGGFLSGNPVAAMEASRLVGEACQEHGFFLVVNHGVDADLIADAHRYMDYFFELPLCDKQRAQRKLGEHCGYASSFTGKISTKLPWKETLSFRFSAEKRSSHMVEEYFEKTLGDEFAHLGNVYQEYCNAMSTLSLGIMELLGMSLGISRESFKDFFQDNESIMRLNYYPPCQKPELTLGTGPHCDPTSLTILHQDTVGGLQVFVDGEWRSISPNVSAFVVNIGDTFVALSNGRYKSCLHRAVVNNKTPRKSLAFFLCPKEDKVVSPPSELVDSNNPRIYPDFTWAKLLEFTQKHYRADMNTLQIFSNWLQQKNS

SEQ ID NO: 2549 - DNA, 1137 bp, Solanum lycopersicum
  misc_feature (1)..(1137): Ceres Annot ID no. 8461546
  misc_feature (1)..(1137): Encodes the peptide sequence at SEQ ID NO. 2550
atgaccactaatagtataatcacaaaagaaaaatcacctatgcttggtgaggaaaaaccattgatttttgattcatcccatatgaaaaatgagttcaacattcctacacaatatatatggccagatgatgagaagccatgtgttgtagcacaagaacttcatgttcctcttattgacttaatgagtttcttttctggtgaccccgtcgcgacccaacaagcatctaggcttgttgatgaagcgtgcaggagtcatggtttctttcttgtagtaaatcacggagttgagtctaatctaatctccaatgcccatcgttacatggacacgttctttgacatgcctctctatgaaaaacaaaaagctcggagaaaaattggtgagcattgtggctacgccagcagctttactggaagattttcttcgaaacttccttggaaagagacactctctttacgatacaccgctaaagaaaactcatctcacataattaaagagtattttcaaaggacattgggtgaaagtttcaataatctcgggaatgtttatcaagaatattgcaattccatgaatacactttctcttaggatcatggaactcttaggaatcagcctgggtgtacaaaagagtcactttaaagagtttttcgaagacaatgattccataatgagactcaactactatcccccgtgcctgaaaccagagctcaccttaggaacagggccgcactatgatccaacatcattaaccgttctccatcaggattgtgttagtggatttcaggtttttgtggacaatgaatggtactccatcagtccaaatttcaatgcatttgtggttaacataggcgacacatttatggcactatcgaatggtatatacaaaagttgcttgcatagagcagttgttaacaacacaactcctaggaaatcactagctttctttctttgtccacacaaagataaggtggtgactccaccaactgaattggtggactacaacaaccctcgactatatcctgacttcacatggcctgctctccttgagtttactcaaaagcattatagagctgataaaaacactcttcaagctttctcaatgtggcttcaagaaaataatgcagaagctaaatatgagtaa

SEQ ID NO: 2550 - protein, 378 aa, Solanum lycopersicum
  misc_feature (218)..(317): Pfam Name: 2OG-FeII_Oxy Pfam Description: 2OG-Fe(II) oxygenase superfamily
  misc_feature (1)..(378): Ceres Annot ID no. 8461546
  misc_feature (1)..(378): Bit score of 821.3 for HMM based on sequences of Figure 31
  misc_feature (1)..(378): Functional Homolog Of SEQ ID NO. 2493
MTTNSIITKEKSPMLGEEKPLIFDSSHMKNEFNIPTQYIWPDDEKPCVVAQELHVPLIDLMSFFSGDPVATQQASRLVDEACRSHGFFLVVNHGVESNLISNAHRYMDTFFDMPLYEKQKARRKIGEHCGYASSFTGRFSSKLPWKETLSLRYTAKENSSHIIKEYFQRTLGESFNNLGNVYQEYCNSMNTLSLRIMELLGISLGVQKSHFKEFFEDNDSIMRLNYYPPCLKPELTLGTGPHYDPTSLTVLHQDCVSGFQVFVDNEWYSISPNFNAFVVNIGDTFMALSNGIYKSCLHRAVVNNTTPRKSLAFFLCPHKDKVVTPPTELVDYNNPRLYPDFTWPALLEFTQKHYRADKNTLQAFSMWLQENNAEAKYE

SEQ ID NO: 2551 - protein, 375 aa, Solanum tuberosum subsp. andigena
  misc_feature (218)..(317): Pfam Name: 2OG-FeII_Oxy Pfam Description: 2OG-Fe(II) oxygenase superfamily
  misc_feature (1)..(375): Public GI ID no. 10800976
  misc_feature (1)..(375): Bit score of 821.1 for HMM based on sequences of Figure 31
  misc_feature (1)..(375): Functional Homolog Of SEQ ID NO. 2493
MAIDCMVMPMIQTSSDEKNPLIFDSSVLKHESNIPRQFIWPDHEKPSGGVPELDVPLIDLGAFLSGDPIAAKRESRLVDEACKNHGFFLVGNHGVDTNLISLAHRYMNMFFELPLSNKQMIQRKRGDHCGYASSFTERFSSKLPWKETLSFSYSALQGSSHMVDQYFLKTMGEDFSHIGKFYQEYCNAMSTLSSGIMELLGESLGVSKNHFKQFFEENESIMRLNYYPTCQKPDLALGTGPHCDPTSLTILHQDSVSGLQVFMDNQWRSISPNLSAFVVNIGDTFMALSNGRYKSCLHRAVVNNKTPRKSLAFFLCPKKDKVVRPPAELVDSNNPRIYPDFTWPTLLEFTQKHYRADTNTLQFFSNWLQQRTTEV

SEQ ID NO: 2552 - DNA, 1155 bp, Populus balsamifera subsp. trichocarpa
  misc_feature (1)..(1155): Ceres Annot ID no. 1524411
  misc_feature (1)..(1155): Encodes the peptide sequence at SEQ ID NO. 2553
atgcccattgattgtttcccttcaaacatgacaattatgcctcctcctcctcctcctccagagccattagtatttgatgcttcaatccttcaacaccaagcgaacttaccctctcagttcatttggcctgaccacgaaaaaccatgccttgaacccccagaacttgcaatccctccgattgattttggaagcttcctcactggagatcctttggcggtctcaaaacttgcccagcaagtaaatgaggcatgcaagaagcatggtttctttgtaattgttaatcatggtgttgactcaaagcttatagctaaagctcatgagggtatgaacatgttctttggtaagcagctctcggagaagccagttcaaaggaagataggagagcaatatgggtatgccagtagcttcactggaagattctcctccaagcttccatggaaagaaacactttctttcagatattgtgctgacaatcagtcctctaacatcgtccaagaatacttcttgaatgtaatgggagaagaattcaaacagttcgggaaggtgtaccaagaatattgtgaagccatgaacactctttcccttggaattatggagctattaggagtaagtctaggagttggaaacgaatattttagagatttcttcgaaggaaatgattcaataatgagactaaattactaccctccttgccaaaaaccggaattaactcttggcactgggcctcactgtgatcctacatccttaacaattcttcatcaagatcatgtcagtggccttcaagtgttcgtcgaagaaaaatggcactccgttactcctgatccggaagctttcgtcgttaacattggtgacacattcatggctctatcaaatggcattttcaagagttgcttgcatagagcagtggtaaataacgtaacagtaaggaaatccctcgctttctttctatgtccaaaaatggacaaggtggtgaagccaccaaatactttggtcgactataaaaatccaagggtatatccggacttcacatggctagctttgtcagaattcacacaaaaacattacagggctgacatgaaaaccctagatgtcttcacaacatggcttcaacaaaaaaacaactgcgggggtaccaaaaatgcttcttcctgttaa

SEQ ID NO: 2553 - protein, 372 aa, Populus balsamifera subsp. trichocarpa
  misc_feature (207)..(306): Pfam Name: 2OG-FeII_Oxy Pfam Description: 2OG-Fe(II) oxygenase superfamily
  misc_feature (1)..(372): Ceres Annot ID no. 1524411
  misc_feature (1)..(372): Bit score of 749.6 for HMM based on sequences of Figure 31
  misc_feature (1)..(372): Functional Homolog Of SEQ ID NO. 2493
MPPPPPPPEPLVFDASILQHQANLPSQFIWPDHEKPCLEPPELAIPPIDFGSFLTGDPLAVSKLAQQVNEACKKHGFFVIVNHGVDSKLIAKAHEGMNMFFGKQLSEKPVQRKIGEQYGYASSFTGRFSSKLPWKETLSFRYCADNQSSNIVQEYFLNVMGEEFKQFGKVYQEYCEAMNTLSLGIMELLGVSLGVGNEYFRDFFEGNDSIMRLNYYPPCQKPELTLGTGPHCDPTSLTILHQDHVSGLQVFVEEKWHSVTPDPEAFVVNIGDTFMALSNGIFKSCLHRAVVNNVTVRKSLAFFLCPKMDKVVKPPNTLVDYKNPRVYPDFTWLALSEFTQKHYRADMKTLDVFTTWLQQKNNCGGTKNASSC

SEQ ID NO: 2554 - DNA, 1499 bp, Arabidopsis thaliana
  misc_feature (1)..(1499): Ceres Annot ID no. 881675
  misc_feature (1)..(1499): Encodes the peptide sequence at SEQ ID NO. 2555
accgaccactgtactgaatctttaagcctctcaacgtgttttttatatatattttgaaaatcttttacgccttaaaaggatctacgataattaaaaaaaaatggcaacggaatgcattgcaacggtccctcaaatattcagtgaaaacaaaaccaaagaggattcttcgatcttcgatgcaaagctccttaatcagcactcgcaccacatacctcaacagttcgtatggcccgaccacgagaaaccttctacggatgttcaacctctccaagtcccactcatagacctagccggtttcctctccggcgactcgtgcttggcatcggaggctactagactcgtctcaaaggctgcaacgaaacatggcttcttcctaatcactaaccatggtgtcgatgagagcctcttgtctcgtgcctatctgcatatggactctttctttaaggccccggcttgtgagaagcagaaggctcagaggaagtggggtgagagctccggttacgctagtagtttcgtcgggagattctcctcaaagctcccgtggaaggagactctgtcgtttaagttctctcccgaggagaagatccattcccaaaccgttaaagactttgtttctaagaaaatgggcgatggatacgaagatttcgggaaggtttatcaagaatacgcggaggccatgaacactctctcactaaagatcatggagcttcttggaatgagtcttggggtcgagaggagatattttaaagagtttttcgaagacagcgattcaatattccggttgaattactacccgcagtgcaagcaaccggagcttgcactagggacaggaccccactgcgacccaacatctctaaccatacttcatcaagaccaagttggcggtctgcaagttttcgtggacaacaaatggcaatccattcctcctaaccctcacgctttcgtggtgaacataggcgacaccttcatggctctaacgaatggaagatacaagagttgtttgcatcgggcggtggtgaacagcgagagagaaaggaagacgtttgcattcttcctatgtccgaaaggggaaaaagtggtgaagccaccagaagaactagtaaacggagtgaagtctggtgaaagaaagtatcctgattttacgtggtctatgtttcttgagttcacacagaagcattatagggcagacatgaacactcttgacgagttctcaatttggcttaagaacagaagaagtttctaaaattgaggagacaatgttgtggtccagaaggtcacttgtagttatgtatagagctttcactgtttttcttaagatgttcaagacttgttaaggatcggagacttttttgttcttttattatcttgctctaggttgtctggtgttaaataaaagtagcaaaaaaataaaaatatatgtactccattgggtctacttatgatttgtttcgaaatggtttttttatagtctctaatgttaaatttatgtcactattact

SEQ ID NO: 2555 - protein, 380 aa, Arabidopsis thaliana
  misc_feature (222)..(321): Pfam Name: 2OG-FeII_Oxy Pfam Description: 2OG-Fe(II) oxygenase superfamily
  misc_feature (1)..(380): Ceres Annot ID no. 881675
  misc_feature (1)..(380): Bit score of 739.1 for HMM based on sequences of Figure 31
  misc_feature (1)..(380): Functional Homolog Of SEQ ID NO. 2493
MATECIATVPQIFSENKTKEDSSIFDAKLLNQHSHHIPQQFVWPDHEKPSTDVQPLQVPLIDLAGFLSGDSCLASEATRLVSKAATKHGFFLITNHGVDESLLSRAYLHMDSFFKAPACEKQKAQRKWGESSGYASSFVGRFSSKLPWKETLSFKFSPEEKIHSQTVKDFVSKKMGDGYEDFGKVYQEYAEAMNTLSLKIMELLGMSLGVERRYFKEFFEDSDSIFRLNYYPQCKQPELALGTGPHCDPTSLTILHQDQVGGLQVFVDNKWQSIPPNPHAFVVNIGDTFMALTNGRYKSCLHRAVVNSERERKTFAFFLCPKGEKVVKPPEELVNGVKSGERKYPDFTWSMFLEFTQKHYRADMNTLDEFSIWLKNRRSF

SEQ ID NO: 2556 - protein, 374 aa, Spinacia oleracea
  misc_feature (216)..(315): Pfam Name: 2OG-FeII_Oxy Pfam Description: 2OG-Fe(II) oxygenase superfamily
  misc_feature (1)..(374): Public GI ID no. 1144390
  misc_feature (1)..(374): Bit score of 729.0 for HMM based on sequences of Figure 31
  misc_feature (1)..(374): Functional Homolog Of SEQ ID NO. 2493
MMQPLLTIPPPLPTTSLFDTSFLKHEDNIPSQFIWPDDEKPCSETPPELEVPPIDLGGFLSGDPVAVSKATTLANEACKWHGFFLIVNHDIYFELLVKAHEAMDYFFSQPFSQKQKALRKQGDHCGYASSFLGRFATKLPWKETLSFRYYDDDDDKSSKMVQNYISNLMGTDFQEFGRVYQEYCKAMSKLSLGIMELLGMSLGVGRNYFREFFKGNDSIIRLNYYPPCQKPELTLGTGPHCDPTSLTILHQDHVGGLEVFVDQKWYSIRPNQKAFVVNIGDTFMALSNGKYKSCLHRAVVNSKTPRKSVAFFLCPRGNKVIRPPIELGHPRVYPDFTWPLLLEFTQKHYRADTKTLDSFTKWLQKRSTEDERVK

SEQ ID NO: 2557 - protein, 379 aa, Lactuca sativa
  misc_feature (223)..(322): Pfam Name: 2OG-FeII_Oxy Pfam Description: 2OG-Fe(II) oxygenase superfamily
  misc_feature (1)..(379): Public GI ID no. 9971219
  misc_feature (1)..(379): Bit score of 745.8 for HMM based on sequences of Figure 31
  misc_feature (1)..(379): Functional Homolog Of SEQ ID NO. 2493
MPPFLLPSPSRLPKKETNFRNNPFIFDASFLQNETSIPQQFMWPEDEKPHLDLPLPQLRVPPIDLNDFLTGDSLAVCNAAQLVDAACREHGFFQVVNHGIDQRLINEAHKIMDLFFGMPLLEKQKAQRKVGEYCGYASSFTNRFSSKLPWKETLSVRYSADPLSSNLVQDYFLKVMGEDFSYLGRVCQEYCEAMSKLSLSIIELLGMSLGIGQSYFRDFYEENDSIMRLNYYPPCQKPDQTLGTGPHCDPTSLTILHQDNVGGLEVFVDEKWHSIAPCSEAFVVNIGDTFMALSNGLYKSCLHRAVVNNHTPRKSLAFFLSPRMDKVVCPPKPLVEDVDKQRRYPDFTWSTFLEFTQKHYRADKNTLDAFSNWLKNGRK

SEQ ID NO: 2558 - protein, 367 aa, Nicotiana tabacum
  misc_feature (212)..(311): Pfam Name: 2OG-FeII_Oxy Pfam Description: 2OG-Fe(II) oxygenase superfamily
  misc_feature (1)..(367): Public GI ID no. 3327247
  misc_feature (1)..(367): Bit score of 741.8 for HMM based on sequences of Figure 31
  misc_feature (1)..(367): Functional Homolog Of SEQ ID NO. 2493
MHDETQNEKTTSLVFDALFLQNNSNIPQQFIWPEGERPCPEPPPPLHVPPIDLNDYLSGDPLAVSNATRLVNQACRKHGFFLVVNHGIDSKLINEAHKNMDFFFEKPLVEKERAKRKLGDYCGYASSFTSRFSCNLPWKETLSFRYSAEVPSSQHIVQSYILNVMGQDYTHFGNVYQKYCEEMSKLSLKVMELLGESLGVGRAYFREFFEGNDSIMRLNYYPPCKKPDLTLGTGPTCDPTSLTILHQDNVGGLEVFVDEKWYSIPPNTNAFVVNIGDTFMVMSNGTYKSCLHRAVVNSRKPRKSLAFFLCPKKDKIVSPPKELITRNVPRKFPDFTWPVFLEFTQKHYRADKKTLDAFVHWLLHKGY

SEQ ID NO: 2559 - DNA, 1442 bp, Triticum aestivum
  misc_feature (1)..(1442): Ceres Clone ID no. 818172
  misc_feature (1)..(1442): Encodes the peptide sequence at SEQ ID NO. 2560
agacacccaacttgtcaccaccatcctctcctcctcctcctcctctatccagtgagctcgagtcggcactgcactctctctgccagctccggatcgatctcggcttcttgatcgatccatcgtttgttgtctggcctagcacactcgggttcttggtccagtcgatcatggtgcagccggtgttcgacgcggcggtgctgagcggccgggcggacatcccgtcgcagttcatctggcccgagggcgagagcccgaccccggacgccgccgaggagctgcacgtcccgctcatcgacatcggcggcatgctctccggcgaccccgccgcggccgccgaggtgacgcgcctcgtgggcgaggcctgcgagcggcacggcttcttccaggtcgtgaaccacggtatcgacgccgagctgctggccgacgcgcaccgctgcgtggacaacttcttcacgatgcccctcccggagaagcagcgcgcgctgcgccaccccggcgagtcgtgcggctacgccagcagcttcaccggccggttcgcgtccaagctgccgtggaaggagaccctgtccttccgctcctgcccctccgaccccgccctcgtcgtcgactacatcgtcgccaccctcggcgaggaccaccgccgcctcggggaggtgtacgctcggtactgctcggagatgagccgtctgtcgctggagatcatggaggtgctcggggagagcctgggcgtcggccgcgcccactaccggcgcttcttcgagggcaacgactccatcatgcgcctcaactactacccgccgtgccagcggccgttggagacgctgggcacgggcccgcattgcgacccgacgtccctgaccatcctccaccaggacaacgtcggcggcctgcaggtgcacacggagggccggtggcgctccatccgaccccgcgccgacgccttcgtggtcaacatcggcgacaccttcatggcgctgtctaacggacggtacaagagctgcctccacagagcggtggtgaacagccgggtcccgaggaagtcgctggccttcttcctgtgcccggagatggacaaggtggtggcgccgccggggacgctggtggacgccgccaacccgcgcgcctacccggacttcacgtggcggtcgctgctggacttcacgcagaagcactaccgggccgacatgaagaccctcgaggtcttctcctcctggatcgtccagcagcagcagccccagcccgccaggacatgatggattgctctgctcctcccaccattagccagccattgattcagcttagctgctgagactgagaaaagagagacatcgtcatccgtcgatcgaatgttattattacagcttaattggttgatctagtggtagcacgtacgtacgaagaagcatggatggatggcaggatttcctagatgataatttcct

SEQ ID NO: 2560 - protein, 361 aa, Triticum aestivum
  misc_feature (200)..(299): Pfam Name: 2OG-FeII_Oxy Pfam Description: 2OG-Fe(II) oxygenase superfamily
  misc_feature (1)..(361): Ceres Clone ID no. 818172
  misc_feature (1)..(361): Bit score of 757.4 for HMM based on sequences of Figure 31
  misc_feature (1)..(361): Functional Homolog Of SEQ ID NO. 2493
MVQPVFDAAVLSGRADIPSQFIWPEGESPTPDAAEELHVPLIDIGGMLSGDPAAAAEVTRLVGEACERHGFFQVVNHGIDAELLADAHRCVDNFFTMPLPEKQRALRHPGESCGYASSFTGRFASKLPWKETLSFRSCPSDPALVVDYIVATLGEDHRRLGEVYARYCSEMSRLSLEIMEVLGESLGVGRAHYRRFFEGNDSIMRLNYYPPCQRPLETLGTGPHCDPTSLTILHQDNVGGLQVHTEGRWRSIRPRADAFVVNIGDTFMALSNGRYKSCLHRAVVNSRVPRKSLAFFLCPEMDKVVAPPGTLVDAANPRAYPDFTWRSLLDFTQKHYRADMKTLEVFSSWIVQQQQPQPART

SEQ ID NO: 2561 - DNA, 1279 bp, Zea mays
  misc_feature (1)..(1279): Ceres Clone ID no. 329121
  misc_feature (1)..(1279): Encodes the peptide sequence at SEQ ID NO. 2562
gacgagcaagcaagcagttgcagttgcagcggcctcctcctctgcttcctccctcctcctcctcaccatggtgctggctgcgcacgatccccctccccttgtgttcgacgctgcccgcctgagcggcctctccgacatcccgcagcagttcatctggccggcggacgagagccccaccccggactccgccgaggagctggccgtgccgctcatcgacctctccggggacgccgccgaggtggtccggcaggtccggcgcgcctgcgacctgcacggcttcttccaggtggtggggcacggcatcgacgcggcgctgacggcggaggcccaccgctgcatggacgccttcttcacgctgccgctcccggacaagcagcgcgcgcagcgccgccagggggacagctgcggctacgccagcagcttcacgggccggttcgcgtccaagctgccctggaaggagacgctgtcgttccgctacaccgacgacgacgacggcgacaagtccaaggacgtcgtggcgtcctacttcgtggacaagctgggcgaggggtaccggcaccacggggaggtgtacgggcgctactgctctgagatgagccgtctgtcgctggagctcatggaggtgctaggcgagagcctgggcgtgggccggcgccacttccggcgcttcttccaggggaacgactccatcatgcgcctcaactactacccgccgtgccagcggccctacgacacgctgggcacggggccgcattgcgaccccacgtcgctcaccatcctgcaccaggacgacgtgggcggactccaggtgttcgacgccgccacgctcgcgtggcgctccatcaggccccgcccgggcgccttcgtcgtcaacatcggcgacaccttcatggcgctctccaacgggcgctacaggagctgcctccaccgcgccgtcgtcaacagccgggtggcacgccgctcgctcgccttcttcctgtgcccggagatggacaaggtggtcaggccgcccaaggagctggtggacgacgccaacccgagggcgtacccggacttcacgtggaggacgctgctggacttcaccatgaggcactacaggtcggacatgaggacgctcgaggccttctccaactggctcagcaccagtagcaatggcggacagcacctgctggagaagaagtaggcatgctatttgggtatggaagatggtggatgtaagcaaacaaagccaaattaagcagagtaggttaattaaggttggctgatgatccatttaggg

SEQ ID NO: 2562 - protein, 371 aa, Zea mays
  misc_feature (205)..(306): Pfam Name: 2OG-FeII_Oxy Pfam Description: 2OG-Fe(II) oxygenase superfamily
  misc_feature (1)..(371): Ceres Clone ID no. 329121
  misc_feature (1)..(371): Bit score of 676.2 for HMM based on sequences of Figure 31
  misc_feature (1)..(371): Functional Homolog Of SEQ ID NO. 2493
MVLAAHDPPPLVFDAARLSGLSDIPQQFIWPADESPTPDSAEELAVPLIDLSGDAAEVVRQVRRACDLHGFFQVVGHGIDAALTAEAHRCMDAFFTLPLPDKQRAQRRQGDSCGYASSFTGRFASKLPWKETLSFRYTDDDDGDKSKDVVASYFVDKLGEGYRHHGEVYGRYCSEMSRLSLELMEVLGESLGVGRRHFRRFFQGNDSIMRLNYYPPCQRPYDTLGTGPHCDPTSLTILHQDDVGGLQVFDAATLAWRSIRPRPGAFVVNIGDTFMALSNGRYRSCLHRAVVNSRVARRSLAFFLCPEMDKVVRPPKELVDDANPRAYPDFTWRTLLDFTMRHYRSDMRTLEAFSNWLSTSSNGGQHLLEKK

SEQ ID NO: 2563 - DNA, 1140 bp, Sorghum bicolor
  misc_feature (1)..(1140): Ceres Annot ID no. 8631464
  misc_feature (1)..(1140): Encodes the peptide sequence at SEQ ID NO. 2564
atggtgcagcaggcgtcgcttggtgagccgctgctgctccagccgccgccgccgtccctggtgttcgacgccgcccgtctgagcggtctgtccgacatcccgcagcaatttctgtggcccgccgacgagagccccaccccggacgccgccgaggagctggccgtgccgctcatcgacctctccggggacgccgccgaggtggtccgccaggtgcgccgcgcctgcgacctgcacggcttcttccaggtggtgaaccacggcatcgacgacgcgctcctgcaggaggcgcaccgctgcatggacgccttcttcacgctccccatgtccgacaagcagcgcgcgcagcgccgtcagggggacagctgcggatacgccagcagcttcacgggccgcttcgcgtccaagctgccatggaaggagacgctgtcgttccgctactccgacgaccagggcgacggcgacgtcgtcgtggactacttcgtcgacaagctgggcgatgcgtaccgtcaccacggggaggtgtacggccgctactgctccgagatgagccggctgtcgctggagctgatggaggtgctcggggagagcctcggcgtgggccgccgccacttccgccgcttcttccaggggaacgactccatcatgcgcctcaactactacccgccgtgccagcggccctacgacacgctgggcaccggaccgcattgcgaccccacctccctcaccatcctccaccaggacgacgtcggaggcctccaggtgttcgacgccgccaccggccccggcaccggccgctggcgctccatcaggccccacccgggcgccttcgtcgtcaacatcggcgacaccttcatggcgctctccaacggacgctacaggagctgcctgcaccgcgccgtcgtcaacagccgggtgccccgccgctcgctcgccttcttcctgtgcccggagatggacaaggtggtgcgcccgcccgccgagctggtggacgacgccaacccgagggcgtacccggacttcacgtggcggacgctgctcgacttcaccatgaggcactacaggtccgacatgaggacgctcgaggcattctccaactggctcaaccatggcggacacctctcatcaccacctcctccatga

SEQ ID NO: 2564 - protein, 379 aa, Sorghum bicolor
  misc_feature (211)..(316): Pfam Name: 2OG-FeII_Oxy Pfam Description: 2OG-Fe(II) oxygenase superfamily
  misc_feature (1)..(379): Ceres Annot ID no. 8631464
  misc_feature (1)..(379): Bit score of 690.6 for HMM based on sequences of Figure 31
  misc_feature (1)..(379): Functional Homolog Of SEQ ID NO. 2493
MVQQASLGEPLLLQPPPPSLVFDAARLSGLSDIPQQFLWPADESPTPDAAEELAVPLIDLSGDAAEVVRQVRRACDLHGFFQVVNHGIDDALLQEAHRCMDAFFTLPMSDKQRAQRRQGDSCGYASSFTGRFASKLPWKETLSFRYSDDQGDGDVVVDYFVDKLGDAYRHHGEVYGRYCSEMSRLSLELMEVLGESLGVGRRHFRRFFQGNDSIMRLNYYPPCQRPYDTLGTGPHCDPTSLTILHQDDVGGLQVFDAATGPGTGRWRSIRPHPGAFVVNIGDTFMALSNGRYRSCLHRAVVNSRVPRRSLAFFLCPEMDKVVRPPAELVDDANPRAYPDFTWRTLLDFTMRHYRSDMRTLEAFSNWLNHGGHLSSPPPP

SEQ ID NO: 2565 - DNA, 243 bp, Arabidopsis thaliana
  misc_feature (1)..(243): Ceres Annot ID no. 851842
  misc_feature (1)..(243): Encodes the peptide sequence at SEQ ID NO. 2566
atggcggcgatgaaatacaaaggaagcgtttttatcatattagtcatccttcttctttcgtcctcactacttgctcactcttcttctacaaaatccttcttttggttaggagaaacacaagatacgaaagccatgaaaaaggagaagaagattgatggaggaacagctaatgaagttgaagaaagacaagttccaactggatccgaccctcttcatcataaacacattccttttactccatag

SEQ ID NO: 2566 - protein, 80 aa, Arabidopsis thaliana
  misc_feature (1)..(80): Ceres Annot ID no. 851842
  misc_feature (1)..(80): Bit score of 161.0 for HMM based on sequences of Figure 28
  misc_feature (1)..(80): in Figure 28
MAAMKYKGSVFIILVILLLSSSLLAHSSSTKSFFWLGETQDTKAMKKEKKIDGGTANEVEERQVPTGSDPLHHKHIPFTP

SEQ ID NO: 2567 - protein, 96 aa, Arabidopsis thaliana
  misc_feature (1)..(96): Public GI ID no. 84028190
  misc_feature (1)..(96): Bit score of 213.0 for HMM based on sequences of Figure 28
  misc_feature (1)..(96): Functional Homolog Of SEQ ID NO. 2566
  misc_feature (1)..(96): in Figure 28
MDSKSFLLLLLLFCFLFLHDASDLTQAHAHVQGLSNRKMMMMKMESEWVGANGEAEKAKTKGLGLHEELRTVPSGPDPLHHHVNPPRQPRNNFQLP

SEQ ID NO: 2568 - protein, 100 aa, Medicago truncatula
  misc_feature (1)..(100): Public GI ID no. 124359888
  misc_feature (1)..(100): Bit score of 231.9 for HMM based on sequences of Figure 28
  misc_feature (1)..(100): Functional Homolog Of SEQ ID NO. 2566
  misc_feature (1)..(100): in Figure 28
MASKFIFSSVFLLVLFCLLFIKETSAGCNTAYACSYANGESLKMFQNRKMLSGLKVSLEGSSTKIKYGEKTVVGELRKVPTGPDPLHHHNIGNPIKPENP

SEQ ID NO: 2569 - protein, 113 aa, Populus trichocarpa
  misc_feature (1)..(113): Public GI ID no. 224057515
  misc_feature (1)..(113): Bit score of 269.9 for HMM based on sequences of Figure 28
  misc_feature (1)..(113): Functional Homolog Of SEQ ID NO. 2566
  misc_feature (1)..(113): in Figure 28
MAFGDGLSRFSSISIALIILTFVLMPLVHSSRSSSLNIRFTNMACNLIMFAMHETTVAAGNRARASAQDIHQSYKITRMGKGASSLVTDEESEREVPTGPDPLHHNNNPTTRP

SEQ ID NO: 2570 - protein, 71 aa, Ricinus communis
  misc_feature (1)..(71): Public GI ID no. 255544778
  misc_feature (1)..(71): Bit score of 10.4 for HMM based on sequences of Figure 28
  misc_feature (1)..(71): Functional Homolog Of SEQ ID NO. 2566
MAVFLSFVYSSRTRLQIRVAEDHTANVTQDLDSHLVKSLGKGASAIYVEDSAREVPTGPDPLHHNRNPTRP

SEQ ID NO: 2571 - protein, 96 aa, Arabidopsis thaliana
  misc_feature (1)..(96): Public GI ID no. 4680323
  misc_feature (1)..(96): Bit score of 212.5 for HMM based on sequences of Figure 28
  misc_feature (1)..(96): Functional Homolog Of SEQ ID NO. 2566
MDSKSFVLLLLLFCFLFLHDASDLTQAHAHVQGLSNRKMMMMKMESEWVGANGEAEKAKTKGLGLHEELRTVPSGPDPLHHHVNPPRQPRNNFQLP

SEQ ID NO: 2572 - protein, 110 aa, Arabidopsis thaliana
  misc_feature (1)..(110): Public GI ID no. 5306272
  misc_feature (1)..(110): Bit score of 191.4 for HMM based on sequences of Figure 28
  misc_feature (1)..(110): Functional Homolog Of SEQ ID NO. 2566
MDSKSFLLLLLLFCFLFLHDASGLTLSFTPLYVYNSYLTQAHAHVQGLSNRKMMMMKMESEWVGANGEAEKAKTKGLGLHEELRTVPSGPDPLHHHVNPPRQPRNNFQLP

SEQ ID NO: 2573 - protein, 92 aa, Arabidopsis thaliana
  misc_feature (1)..(92): Public GI ID no. 42570935
  misc_feature (1)..(92): Bit score of 153.4 for HMM based on sequences of Figure 28
  misc_feature (1)..(92): Functional Homolog Of SEQ ID NO. 2566
MDSYKSQHNFFLLFTISPDLTQAHAHVQGLSNRKMMMMKMESEWVGANGEAEKAKTKGLGLHEELRTVPSGPDPLHHHVNPPRQPRNNFQLP

SEQ ID NO: 2574 - DNA, 783 bp, Arabidopsis thaliana
  misc_feature (1)..(783): Ceres Annot ID no. 860028
  misc_feature (1)..(783): Encodes the peptide sequence at SEQ ID NO. 2575
cactcagtcactttctctctaaaaatggattcgaagagttttctgctactactactactcttctgcttcttgttccttcatgatgcttctggtctcactctctctttcactcctctatatgtctataactcatgtaaatggattcttataagtctcaacataacttttttttgttatttactatttcaccagatctcactcaagctcatgctcacgttcaaggactttccaaccgcaaggttatcttcaacttgtactcattaaggcctctcaatattcatgtgttatgttcatgtagatgtccggtccagttcaacaactgtttcattgctttagttgtcacgagaaatatttgtatatattattatggtgtgcaaaacatagtaaaatgttgttcaattggcagatgatgatgatgaaaatggaaagtgaatgggttggagcaaatggagaagcagagaaggcaaagacgaagggtttaggactacatgaagagttaaggactgttccttcgggacctgacccgttgcaccatcatgtgaacccaccaagacagccaagaaacaactttcagctcccttgacctaatctcttgttgctttaaattatttcatattgtaaattactttctgctttatcggttttaccatttcgggagtcttttttgtgtgcaatctgtttcgtttggtaagcttgtagtttcatgaaagtgaatgtaagatatgcattacgtttgttgctgaagtgaatgtaagatacgcactattatatctcatgattttc

SEQ ID NO: 2575 - protein, 94 aa, Arabidopsis thaliana
  misc_feature (1)..(94): Ceres Annot ID no. 860028
  misc_feature (1)..(94): Bit score of 106.2 for HMM based on sequences of Figure 28
  misc_feature (1)..(94): Functional Homolog Of SEQ ID NO. 2566
MSGPVQQLFHCFSCHEKYLYILLWCAKHSKMLFNWQMMMMKMESEWVGANGEAEKAKTKGLGLHEELRTVPSGPDPLHHHVNPPRQPRNNFQLP

SEQ ID NO: 2576 - protein, 85 aa, Brassica oleracea
  misc_feature (1)..(85): Bit score of 88.7 for HMM based on sequences of Figure 28
  misc_feature (1)..(85): Functional Homolog Of SEQ ID NO. 2566
MAAAMRLKGGVLISIIFFSIVLSSCPLAHSSSTKSFFWLEEREDMKAMKKENEIGVVGSANEVEERQVPTGSDPLHHKHIPFTSP

SEQ ID NO: 2577 - protein, 95 aa, Brassica oleracea
  misc_feature (1)..(95): Bit score of 90.0 for HMM based on sequences of Figure 28
  misc_feature (1)..(95): Functional Homolog Of SEQ ID NO. 2566
NKGRFFHFVLKMAAMRYKGSLLITLIIFFSIVLLQCPLAYSSSTKSFFWLGETEDMNAMKKENEIDVGSAYDVEERRVPTGSDPLHHNHVPFTSP

SEQ ID NO: 2578 - protein, 276 aa, Arabidopsis lyrata subsp. lyrata
  misc_feature: Public GI ID no. 297825687
  misc_feature (1)..(276): Bit score of 472.1 for hmm based on sequences of FIGURE 25.
  misc_feature: Functional Homolog Of SEQ ID NO. 1016
MASSSPTQRTHVSIPPEPGGKSLTQEANEPPVPISVSSPCGKRTRDPEDEVYLDNLRSQKRYLSEIMACSLNGLTVGDSLPVNMLESPARSESFIYHRDDLSLQYSPMSEDSDEARFCEDPTTTASTSSSQPESRPTSPVSPYRYQRPLTSTNSPQPSSTIVHHSHTCPTSMISNATTTTTTPQSRQRGSDTEGRFPSSPSDICHSGDLRRTALLRSVQMRTQPCGYTSSSGPSNIDGEERMCSKSMEEDRGYNRGDDISYTEVSSKSKSCKALDI

SEQ ID NO: 2579 - protein, 269 aa, Ricinus communis
  misc_feature: Public GI ID no. 255548507
  misc_feature (1)..(269): Bit score of 553.3 for hmm based on sequences of FIGURE 25.
  misc_feature: Functional Homolog Of SEQ ID NO. 1016
MGSDSNSTPASTPPSTSTASPNGKRNRDPEDEVYLDNLHSHKRYLSEIMASSLNGLTVGDPIPENLMESPARSDSMFYVWDEMSLQYSPMSEDSDDSRFCETGPINTCSSQPDSLPTSPVSPYRYQRSFGGFSSAPSTSSYPAHGCTVSSVACSQPRQRGSDSEGRFPSSPSDICHSADLRRAALLRSVQMRTQPPGSSSFELPFGSGQEPASNIEAEERPCSYMKSLVDERDYQIEEQSSMGSSEPEFNDGKSCRVLNMNIEGDGSGG

SEQ ID NO: 2580 - DNA, 1081 bp, Zea mays
  misc_feature: Ceres Clone ID no. 226231
  misc_feature: Encodes the peptide sequence at SEQ ID NO. 2581
tttccctaatccccatctccccttctctcgctgctggtggcctgcgaatggcgggcggaagcggcgaggcggctatgtctccgccgtcctctagtgccagcgggaagcgcgggcgggacccggaggaggacgtgtacgtggacaatctccattcccacaaacggtatctcagcgagataatggcatccagtctgaatggactgtctgttggggattcactgcctgacaacatcatggagtcccctgcaaggtcagagactgcttcctgctacagggatgagatattatcccaatactcaccgatgtcagaagactcggatgattaccggtgctatgacactcaattaaaccccagtgggaatcatcctgatgcgatgatcagcccttcaactagcccaatgtcatctcctcatcgacaccagagaccacaatcttctttgttaccttcaaacccataccctctcccaagctgctccctttcgtcagtagtctgctctcatgctcggcgtggctccgataatgaaggccggttcccgtcctcgccaaatgacatgtgccatgtagcagatttgaggcgaacagcactactgaggtcagtgcaaatgagggtgcagggaccccattcgtatgacctatcattcggcatcagacaaggacaagwtcatgcacatgagcatgaaggggaacatgaccatgagcatgaacatctagaggacttggaagggacagaaggatcatcttgcaataagtcaatcgttaacgaagtcacgtacaaccagagacgtgaccatgattttggtcggtcagagcacgagatagattacatcaacaacagcacatcagatgattgtgtaagtgatctaaaatttaagcaagaagataagagccatagtaaatttgatatccctatgcacaaaaattcatagcacatggaacatatgtgttagttttttggattataactctacttaacttcattgtattcttgacggatgccttatctattgtccgtggttttagcatcagcgttctgaatagcgacattgtaatatttgagtgaaattaacctttggattgttgc

SEQ ID NO: 2581 - protein, 292 aa, Zea mays
  misc_feature: Ceres Clone ID no. 226231
  misc_feature (1)..(292): Bit score of 254.0 for hmm based on sequences of FIGURE 25.
  misc_feature: Functional Homolog Of SEQ ID NO. 1016
  misc_feature (205)..(205): Xaa is any aa, unknown, or other
MAGGSGEAAMSPPSSSASGKRGRDPEEDVYVDNLHSHKRYLSEIMASSLNGLSVGDSLPDNIMESPARSETASCYRDEILSQYSPMSEDSDDYRCYDTQLNPSGNHPDAMISPSTSPMSSPHRHQRPQSSLLPSNPYPLPSCSLSSVVCSHARRGSDNEGRFPSSPNDMCHVADLRRTALLRSVQMRVQGPHSYDLSFGIRQGQXHAHEHEGEHDHEHEHLEDLEGTEGSSCNKSIVNEVTYNQRRDHDFGRSEHEIDYINNSTSDDCVSDLKFKQEDKSHSKFDIPMHKNS

SEQ ID NO: 2582 - DNA, 885 bp, Sorghum bicolor
  misc_feature: Ceres Annot ID no. 8725117
  misc_feature: Encodes the peptide sequence at SEQ ID NO. 2583
atgggggccggaagcggagaggcggcgatgtctccgccgtcctccggcggcagcggaagcggcggcgggaagcgcgggcgggacccggaggaggacgtgtacgtggacaatctccactcccacaagcggtacctcagcgagataatggcgtccagtctgaatggactgtctgttggggattcactgcctgacaacatcatggagtcccctgcaaggtcagagactgcttcttgcttcagggatgagatattatcccaatactcgccaatgtcagaagactcagatgattaccggtgctatgacactcaattaaaccccagtgggaatcatcctgatgcgatgatcagcccttcaactagtccaatgtcatctccccaccgacaccagagaccacaatctcctctgttaccttcaaacccataccctctcccaagctgctccctttcatcggtagtctgctctcatgctcggcgtggctccgataatgaaggtcggttcccatcctcaccaaatgacatgtgccacggggcagatctgaggcgaacagcactgctgaggtcagtgcaaatgagggtgcagggaccccattcgtacgacctatcattcggcatgagacaaggacaagaacatgtacatgagcatgaagatgaacatgagcatgaacatctagaggatttggaaaggacagaaaggtcatcatcttgcaataagtcaatcgttgacgaaatcgcgtaccagagacctgaccatgattttggtcaaccagagcacgagatagattacatcaacaactgcacatcagatgattgtccaagtgacctaaaatttaagcatgaagataagagccatagtaaatttgatacccgtatggacaagaatacatag

SEQ ID NO: 2583 - protein, 294 aa, Sorghum bicolor
  misc_feature: Ceres Annot ID no. 8725117
  misc_feature (1)..(294): Bit score of 250.5 for hmm based on sequences of FIGURE 25.
  misc_feature: Functional Homolog Of SEQ ID NO. 1016
MGAGSGEAAMSPPSSGGSGSGGGKRGRDPEEDVYVDNLHSHKRYLSEIMASSLNGLSVGDSLPDNIMESPARSETASCFRDEILSQYSPMSEDSDDYRCYDTQLNPSGNHPDAMISPSTSPMSSPHRHQRPQSPLLPSNPYPLPSCSLSSVVCSHARRGSDNEGRFPSSPNDMCHGADLRRTALLRSVQMRVQGPHSYDLSFGMRQGQEHVHEHEDEHEHEHLEDLERTERSSSCNKSIVDEIAYQRPDHDFGQPEHEIDYINNCTSDDCPSDLKFKHEDKSHSKFDTRMDKNT

SEQ ID NO: 2584 - protein, 288 aa, Oryza sativa Japonica Group
  misc_feature: Public GI ID no. 115462191
  misc_feature (1)..(288): Bit score of 242.2 for hmm based on sequences of FIGURE 25.
  misc_feature: Functional Homolog Of SEQ ID NO. 1016
MVGGGGGGEAAMSPPSGGGKRGRDPEEDVYVDNLHSHKRYLSEIMASSLNGLSVGDSLVDNIMESPARSENTSYFRDEIISQYSPMSEDSDDYRCYDTQLPNGSQTDAMVSPSTSPMSSPHRFQKPQSGLLSANPYPLPSCSLSSVVCSNPRRGSENEGRFPSSPNDMCHGGDLRKTALLRSVQMRVQGPHAYELSFCGRQEQEHAHDHEDEHQHEHLEGLEGAERSSSHRETISDGVSYQMPENSYGRPEHDIDYIEDCTPHGCLSDLKFKQEDKDCSKLTSMDKNR

SEQ ID NO: 2585 - protein, 277 aa, Oryza sativa Indica Group
  misc_feature: Public GI ID no. 218196129
  misc_feature (1)..(277): Bit score of 226.7 for hmm based on sequences of FIGURE 25.
  misc_feature: Functional Homolog Of SEQ ID NO. 1016
MSPPSGGGKRGRDPEEDVYVDNLHSHKRYLSEIMASSLNGLSVGDSLVDNIMESPARSENTSYFRDEIISQYSPMSEDSDDYRCYDTQLPNGSQTDAMVSPSTSPMSSPHRFQKPQSGLLSANPYPLPSCSLSSVVCSNPRRGSENEGRFPSSPNDMCHGGDLRKTALLRSVQMRVQGPHAYELSFCGRQEQEHAHDHEDEHQHEHLEGLEGAERSSSHRETISDGVGYQMPENSYGRPEHDIDYIEDCTPHGCLSDLKFKQEDKDCSKLTSMDKNR

SEQ ID NO: 2586 - DNA, 1217 bp, Triticum aestivum
  misc_feature: Ceres Clone ID no. 779610
  misc_feature: Encodes the peptide sequence at SEQ ID NO. 2587
ctcacttttccccttcgactcttctctagctcccaccctcacctccaagaagcagccaatccagcaacccgtgccgccgcgccgcgccgcgcggatggcgggtggcagcggcgagggcgccgcaatgtcgccgccttcctcctccggcgttggcggcggcggcggtggcggaaagcgcgggagggatccggaggaggacgtgtacgtggacaacctccactcccacaagcggtacctcagcgagataatggcgtccagcctgaatgggctctctgttggagattcgcttgccgacaacatcatggagtcccctgcgaggtcggagagttcctcttgtatcagggacgaaataatctcccaatactcaccaatgtcagaagactcagatgactaccggtacttcgacacacaactaaaccccaacgggagtcaaggtgatgcaatggtcagcccatcaactagtccaatgtcatctcctcaccggttccagaaaccacaagctagtttcctaccatcaagcccatatcctctccccagctgctccctctcatccgtggcttgctctcaccctcggcgtggctctgagaatgaaggccggttcccgtcttcacccaatgacatgtgccatggcgcggacctgaggcgaacggcactactgaggtcggtgcaaatgagggtgcatggtccccatgcgtacgacccatcattcggcagccggcaggagcaagaacatgtccatgagcatgatgatgaacatggtcatgagcatctggaagatttgggagggccagaaagaccatcttgcaggaaatcaattgataatgaagctagtggctaccagggggctgaaaacagctatgggcggcaggagcatgatatcgattacatcgacggctgcacagctgatgatgtcttgagtggccccaagttcaagcaagaagatgataaccaaggtaattctgacgccagcatggataaaactagataggtactatcagagtgcaatcacaccatgcaattgttgtagtattaattatggcaatgggagatcaggttttttgctgttgtaattttctatgcagttggatttgttgcaatctggctgctttccgcaattttgaaattgtggcatttgagtacctgtctgctgtttgaacgaaaaagtcttgcggagagtgatttatagtatatccgtgcatgcaatgttttttctgatt

SEQ ID NO: 2587 - protein, 297 aa, Triticum aestivum
  misc_feature: Ceres Clone ID no. 779610
  misc_feature (1)..(297): Bit score of 235.6 for hmm based on sequences of FIGURE 25.
  misc_feature: Functional Homolog Of SEQ ID NO. 1016
MAGGSGEGAAMSPPSSSGVGGGGGGGKRGRDPEEDVYVDNLHSHKRYLSEIMASSLNGLSVGDSLADNIMESPARSESSSCIRDEIISQYSPMSEDSDDYRYFDTQLNPNGSQGDAMVSPSTSPMSSPHRFQKPQASFLPSSPYPLPSCSLSSVACSHPRRGSENEGRFPSSPNDMCHGADLRRTALLRSVQMRVHGPHAYDPSFGSRQEQEHVHEHDDEHGHEHLEDLGGPERPSCRKSIDNEASGYQGAENSYGRQEHDIDYIDGCTADDVLSGPKFKQEDDNQGNSDASMDKTR

SEQ ID NO: 2588 - protein, 331 aa, Picea sitchensis
  misc_feature: Public GI ID no. 294463836
  misc_feature (1)..(331): Bit score of 224.3 for hmm based on sequences of FIGURE 25.
  misc_feature: Functional Homolog Of SEQ ID NO. 1016
MGWESSALNNGKRVREPEDAVYLDNYHSQKRYLSEVMASSLNGLTVGDSLSESPRMLSPSRFDPMESPARTETVSFSREELAAQYSPMSEDSDDCVGYRMIRCNDSPQHISMTQSDQVISSPTSPVSPQRNQRTINGAGSQFGCSSFTSSTGAGSSSLGYMTSFPLPCTQPRQRSSDSESRFPPSPSDPCQSADLRRAALLRSLQMRAQPPIMPSFEMSVDNISEQGMHHIEESEDQSSPFVKSLTEHDEYSFGSPANEIFSAQPIRSSGRVRSLLLDECTLSTSVSIAELSTSSEQEDEITGISCTNEDNCYTNMNSKNKTGDLASNAKD

SEQ ID NO: 2589 - protein, 86 aa, Arabidopsis lyrata subsp. lyrata
  misc_feature: Public GI ID no. 297838817
  misc_feature (1)..(86): Bit score of 173.6 for hmm based on sequences of FIGURE 39.
  misc_feature: Functional Homolog Of SEQ ID NO. 1
MEDSKKYKRMVKQTMNKKKRNNNNTNHGSGSRSRLLQMKVRRLQILIPGGQRCNHPDLLLSKTVDYIVHLKLKLRFLKALSDMYSL

SEQ ID NO: 2590 - protein, 81 aa, Arabidopsis lyrata subsp. lyrata
  misc_feature: Public GI ID no. 297850868
  misc_feature (1)..(81): Bit score of 107.9 for hmm based on sequences of FIGURE 39.
  misc_feature: Functional Homolog Of SEQ ID NO. 1
MEESRSSHRKERNRMQTKKKTGRGSGSGSIQIKMRKLRVLIPGGRRLNQPDLLLSKTADYIMHLELRIRFLKALSNMYSLS

SEQ ID NO: 2591 - protein, 80 aa, Arabidopsis lyrata subsp. lyrata
  misc_feature: Public GI ID no. 297811417
  misc_feature (1)..(80): Bit score of 135.7 for hmm based on sequences of FIGURE 28.
  misc_feature: Functional Homolog Of SEQ ID NO. 2566
MAAMKYKGSVFIISVILLLSSPLLAHSSSTKSFFWLGETQDTKTMKKEKEINGGTANEVEERQVPTGSDPLHHKHLPFTP

SEQ ID NO: 2592 - protein, 281 aa, Arabidopsis lyrata subsp. lyrata
  misc_feature: Public GI ID no. 297792349
  misc_feature (1)..(281): Bit score of 740.4 for hmm based on sequences of FIGURE 36.
  misc_feature: Functional Homolog Of SEQ ID NO. 2124
MSGSSSPSLWLAPNPSKRWGELFFLFYTPFWLTLCLGIVVPYKLYETFTELEYLLLALVSAVPAFVIPMLLVGKVIDTSLCWKDRYWVKANLWIIMFSYVGNYFWTHYFFKVLGASYTFPSWKMNNVPHTTFFLTHVCFLFYHVASNITLRRLRHSTADLPDSLKWCFEAAWILALSYFIAYLETIAIANFPYYEFVDRSAMYRVGCLFYAIYFIVSFPMFFRMDEKSSDGWDLSRVAVDALGAAMLVTIILDLWRLFLGPIVPLPEGQNCLQSGLPWFSN

SEQ ID NO: 2593 - protein, 286 aa, Solanum lycopersicum
  misc_feature: Public GI ID no. 209976078
  misc_feature (1)..(286): Bit score of 687.4 for hmm based on sequences of FIGURE 36.
  misc_feature: Functional Homolog Of SEQ ID NO. 2124
MKGNKVNSAAPSLWLAQNPSKRWGEVFFLLYTPFWLTLCLGIVVPFKLYEDFTEWEYLLVGLISALPALIVPMIFVGKADRNLAWKDRYWVKANLWIAIFTYVGNYFWTHYFFTVLGASYTFPSWKMNNVPHTTFLLAHVCSLFYHVSANMTLRRLQHAIADLPENVQWAFKAGWILAYAYFIAYLETLAISNFPYYDFVDRAVMYKVGSLFYAIYFIVSYPMFFRVDEKPGDSWDLPRVSIDALGAAMLVTILLDLWRICLGSIVPMPETKQCPQSGLPWFAMTS

SEQ ID NO: 2594 - protein, 301 aa, Sorghum bicolor
  misc_feature: Public GI ID no. 242086735
  misc_feature (1)..(301): Bit score of 783.6 for hmm based on sequences of FIGURE 36.
  misc_feature: Functional Homolog Of SEQ ID NO. 2124
MAAARRPGATKPKGGGGGGAGRRRSAWLAADGSKRWGEAFFLLYTPFWLTLCLGVVVPFKLYERFTELEYLILGLVSTVPAFLIPLFLVGKADSVRNFKDRYWVKANIWIIIFSYVGNYFWTHYFFTVLGASYTFPSWRMNNVPHTTFLLTHACFLFYHMASNMTLRRLRHSAAHLPQSIRWLFEAAWILALSYFIAYLETLAIANFPYYEFVDRDIMYKVGSLFYAIYFIVSFPMFSRIDEKDEKWNLSRVAVDSLGAAMLVTIILDLWRIFLGPIVPIPESRQCGQPGLAWFQVQNEST

SEQ ID NO: 2595 - protein, 248 aa, Glycine max
  misc_feature: Public GI ID no. 255647881
  misc_feature (1)..(248): Bit score of 567.3 for hmm based on sequences of FIGURE 36.
  misc_feature: Functional Homolog Of SEQ ID NO. 2124
MAASASSSPWLAPNPSKRWGELFFLLYTPFWLTLCLGIVIPFNLYEKFTELEYLLIGLVSAVPAFVVPLLLVGKADRSISWKDRYWVKASLWIIIFSYVGNYFWTHYFFTVLGASYTFPSWKMNNVPHTTFLLTHVCLLFYHVSSNMTLRRLRHFIAGLPEKLQWATEAAWILALAYFIAYLETLAISNFPYYQFVDRDSMYKVGSLFYAIYFIVSFPMFLRIDEKPAINGTCLEWLLMLWELQCWSQ

SEQ ID NO: 2596 - protein, 197 aa, Medicago truncatula
  misc_feature: Public GI ID no. 217073736
  misc_feature (1)..(197): Bit score of 411.6 for hmm based on sequences of FIGURE 36.
  misc_feature: Functional Homolog Of SEQ ID NO. 2124
MLFVGKADKGISWQDRYWVKASLWIIIFSYVGNYFWTHYFFTVLGASYTFPSWKMNNVPHTTFLLTHVCFLFYHVASNMTLRRLRHFLADTPEKIRWAAEAAWILALAYFIAYLETLAISNFPYYEFVDRESMYKVGSLFYAIYFIVSFPMFLTIDEKPGDKWDLPRVAVDALGAAMLVTIILDLWRIFLGPIVPVS

SEQ ID NO: 2597 - protein, 277 aa, Volvox carteri f. nagariensis
  misc_feature: Public GI ID no. 302846059
  misc_feature (1)..(277): Bit score of 376.6 for hmm based on sequences of FIGURE 36.
  misc_feature: Functional Homolog Of SEQ ID NO. 2124
MAVNQSASGPHWLAKDPSKRWTEVLILAYSPFWIIWALVLLVPFQIYEYCGNYGYMLIGLSCAAPTVILPLFIRCKADQGKPMWQRFWVKANIWIFIFSFIGNYFWTHYFYKVLGASYTFVSWRINDVPITLILMTHGYFCFYHVISNLLLRRVQTGLAKSSLLVRRSAMALVVFLLSYATAYAETLTIAHFPYYTFVDRDKMYTVGSLFYAIYFFVSFPMFFRMDEYPQKRGAKWTSSEAALDALAAGMLVTILLDLWRITLGGIVELKDQGLPWM

SEQ ID NO: 2598 - protein, 282 aa, Selaginella moellendorffii
  misc_feature: Public GI ID no. 302763909
  misc_feature (1)..(282): Bit score of 256.4 for hmm based on sequences of FIGURE 36.
  misc_feature: Functional Homolog Of SEQ ID NO. 2124
MELSLWLAESPSKRNGELLFLAYSPVWITILLGVIVPFKFYEEFQELEYFAVALMLSSPCIVLPFFLKSRLANLWIGIFGFAGNYFLTHYFYTILGANYTFPSWRLNNLCYRSPCTQPYFLLYHVFSSMTLRRLKAAQAKTSSVAFSRLVQFVSTAILAYLTALIEALTISNLFFIHSDFLSSSHIFPAFYKVGSLLYALYFIVSYPMFMRIDEDPSDEWSFLRTTGNALAASMLVTILLDFWRLTIGPVVDQHHHSWFQQERKLARIFLWKRYKSHPFHIL

SEQ ID NO: 2599 - protein, 292 aa, Aureococcus anophagefferens
  misc_feature: Public GI ID no. 323454458
  misc_feature (1)..(292): Bit score of 227.5 for hmm based on sequences of FIGURE 36.
  misc_feature: Functional Homolog Of SEQ ID NO. 2124
MCLILAAQAVLLVVLQRCVPRPTGRGTWLAPKTNAPKRATELWFLAYAVVWIGAFACIVGFEWYERFDALAYFLVCGGLALPLYAQPFLLPALTYDERRPLAERYSFKANVWLAIFGFVGNYWYTHYFYSVLGAAYTMPAWRLNDVPVAMFFATHFYFCFYHVLSNAALRKIRTSYEPSKRRLAFEAASIVAMSYLTAFMETLTISGFPYYSFEDRDMAYTVGSAFYGIYFLVSFPMFLRLDETPPTVVNGATHDLFATAVEALASSMAVLCLLDFVRLALGIPFAMKVAAA

SEQ ID NO: 2600 - protein, 363 aa, Ectocarpus siliculosus
  misc_feature: Public GI ID no. 298707227
  misc_feature (1)..(363): Bit score of 191.5 for hmm based on sequences of FIGURE 36.
  misc_feature: Functional Homolog Of SEQ ID NO. 2124
MPSERGNTTAQIPSALYSSTPCAVRNVPGDGVWNFLEVAGRSTRPGSFTMGSPRFGDIDVGMAMTAILACMASTLGALLLTLTPKDSKRGGSTWLACAKTNPAKRAWEVFNLRYAVFWVGCFAAIIGFSLYEDFDEVSYMVVCFGLSLPIVAFPLVSMHPSEAGLAVGQRYGVRANVWIAIYSFIGNYWYTHYFYCVLGAKYTFPSWRLNDVPIPLIAATVFYFSLYHALSNMAIRKVVTSFEATTSRAVTLVVLVGVMSYAVAFTETLTISGFPYYEFEDRDMAYVVGSAFYGIYFVVSFPMFYAFDEWPQEDENKLADRKAGNSARGLWGAAVDSLGASMLILCLLDFVRLAVGSEFFMKG

SEQ ID NO: 2601 - protein, 315 aa, Micromonas pusilla CCMP1545
  misc_feature: Public GI ID no. 303282359
  misc_feature (1)..(315): Bit score of 157.7 for hmm based on sequences of FIGURE 36.
  misc_feature: Functional Homolog Of SEQ ID NO. 2124
MGKIFLTLFAVLFALSTTLTRAVRISKGRGEGTLRFVEAKARFLADAKENPSKHHAEIFIIKYSAVWILSVGVVIASRAYEWWGRWGYIVYCGACAAPYVVTPLLRPLKGDRTPAGASSIATWYILKANAWIAVFSFIGNYWYTHYFYGVLKANYTFDAHRLNDVPISMYLMTHAYFMFYHALTNCALRFVKSKYEDDAARWVFTCALVAVMAYTTAFMESLTICGFPYYTFADRDKAYTLGSAFYGIYFLVSFPMFLRVDEDVVGGGKRGGGKGRTTHWTTFWEAMGSGMAVLCLLDFVRVHLGLDFCMYAKGH

SEQ ID NO: 2602 - protein, 282 aa, Phaeodactylum tricornutum CCAP 1055/1
  misc_feature: Public GI ID no. 219128011
  misc_feature (1)..(282): Bit score of 157.9 for hmm based on sequences of FIGURE 36.
  misc_feature: Functional Homolog Of SEQ ID NO. 2124
MPKLDQSGSTFFPSAKLQPSKRSYELFAAAYTPVWISAFCIVVVFQVYEQLDAWGYSRLCGGLAAPFLLQPFLFPSAGSNSPDETRAPWERYAFKANLWIAIYSFIGNYFYTHYFYSVLKAEYSMPAHRLNNVPIAMFLATHFYFSTYHFFSNVLLRKIVTTYEKSFRRTLLFVSTVLVFSYFTAFMETLTISSYPYYSFEDRNTAYTVGSAFYGIYFIVSFPAFFHFDDEVDVDSPTRKVVTVWDTVVSSCGYGMIILILLDFVRIQLGIPLVMDVAKELS

SEQ ID NO: 2603 - DNA, 585 bp, Populus balsamifera subsp. trichocarpa; identical to SEQ ID NO: 1581
  misc_feature: Ceres Annot ID no. 1463921
  misc_feature: Encodes the peptide sequence at SEQ ID NO. 2604

SEQ ID NO: 2604 - protein, 194 aa, Populus balsamifera subsp. trichocarpa; identical to SEQ ID NO: 1582
  misc_feature: Ceres Annot ID no. 1463921
  misc_feature (1)..(194): Bit score of 463.2 for hmm based on sequences of FIGURE 23.
  misc_feature (2)..(188): Pfam Name: AUX_IAA Pfam Description: AUX/IAA family
  misc_feature: Functional Homolog Of SEQ ID NO. 1592

SEQ ID NO: 2605 - protein, 197 aa, Vitis vinifera
  misc_feature: Public GI ID no. 297737772
  misc_feature (1)..(197): Bit score of 387.7 for hmm based on sequences of FIGURE 23.
  misc_feature (31)..(191): Pfam Name: AUX_IAA Pfam Description: AUX/IAA family
  misc_feature: Functional Homolog Of SEQ ID NO. 1592
MDSHSQGFLWSPPSLHPVYYQTKEDDGIIDLGLSLRTLQPQVYHPTGHMGSLEGYGAYGEPVDWPQLEAQSRNSNSGCPKVIPEDCEEETEGVQSKERWAYVKVNMDGVVIGRKICVLDLAGYSSLALQLEDMFGRDSLSGLRLFQRESEFALFYKDREENWRTVGDVPWKEFVDSIKRLRIVRKNEAHFPSSLECT

SEQ ID NO: 2606 - protein, 192 aa, Ricinus communis
  misc_feature: Public GI ID no. 255570659
  misc_feature (1)..(192): Bit score of 315.5 for hmm based on sequences of FIGURE 23.
  misc_feature (96)..(185): Pfam Name: AUX_IAA Pfam Description: AUX/IAA family
  misc_feature: Functional Homolog Of SEQ ID NO. 1592
MDSSASSFFLNPSALQSVYYPAKEDEDIIDLGLSLRTFQPDAYHPSGHYIGQEGYDELMAWPHQGNHPSLRHSNSGYQRNTQQEYDEDAEGVQSKESWAYVKVNMDGVVVGRKICILDHGGYSSLAVQLEDMFGIQTATGLRLFQPGSEFCLFYQDREDNWRTGIYRIRQAAKDCTKKVKIFFCHVHLCLTI

SEQ ID NO: 2607 - protein, 162 aa, Vitis vinifera
  misc_feature: Public GI ID no. 225424081
  misc_feature (1)..(162): Bit score of 353.6 for hmm based on sequences of FIGURE 23.
  misc_feature (3)..(156): Pfam Name: AUX_IAA Pfam Description: AUX/IAA family
  misc_feature: Functional Homolog Of SEQ ID NO. 1592
MDSHSQGFLWSPPSLHPVYYQTKEDDGIIDLGLSLRTLQPQVYHPTGHKDCEEETEGVQSKERWAYVKVNMDGVVIGRKICVLDLAGYSSLALQLEDMFGRDSLSGLRLFQRESEFALFYKDREENWRTVGDVPWKEFVDSIKRLRIVRKNEAHFPSSLECT

SEQ ID NO: 2608 - protein, 179 aa, Vitis vinifera; identical to SEQ ID NO: 1593
  misc_feature: Public GI ID no. 147787084
  misc_feature (1)..(179): Bit score of 252.0 for hmm based on sequences of FIGURE 23.
  misc_feature (24)..(173): Pfam Name: AUX_IAA Pfam Description: AUX/IAA family
  misc_feature: Functional Homolog Of SEQ ID NO. 1592
  misc_feature (2)..(2): Xaa is any aa, unknown, or other
  misc_feature (4)..(4): Xaa is any aa, unknown, or other
  misc_feature (6)..(6): Xaa is any aa, unknown, or other
  misc_feature (20)..(20): Xaa is any aa, unknown, or other
  misc_feature (22)..(22): Xaa is any aa, unknown, or other

SEQ ID NO: 2609 - protein, 192 aa, Arabidopsis lyrata subsp. lyrata
  misc_feature: Public GI ID no. 297814362
  misc_feature (1)..(192): Bit score of 433.3 for hmm based on sequences of FIGURE 23.
  misc_feature (32)..(191): Pfam Name: AUX_IAA Pfam Description: AUX/IAA family
  misc_feature: Functional Homolog Of SEQ ID NO. 1592
MDPNTTADFFQGSSKFHTYYSQTKKGGGVIDLGLSLSTIQHETYLPPARVIGLDGYGELIDWSQQPSYRSITQLKSEDTGHKRLAHGYYNNEEESRGKYAYVKVNLDGLVVGRKVCLLDQGAYSTLALQLNDMFGMQTVSGLRLFQTESEFSLVYRDREGIWRNVGDVPWKEFLESVDRMRIARRNDALFPF

SEQ ID NO: 2610 - protein, 280 aa, Oryza sativa Japonica Group
  misc_feature: Public GI ID no. 115449665
  misc_feature (1)..(280): Bit score of 59.9 for hmm based on sequences of FIGURE 23.
  misc_feature (33)..(264): Pfam Name: AUX_IAA Pfam Description: AUX/IAA family
  misc_feature: Functional Homolog Of SEQ ID NO. 1592
MRGGVAGPTAGEPPGTEAEAEEVEESSAGDDEELELGLSLGSKKQQQQQHAPCRILTARDLQPAAALSPDSSVSSSSPAAAAAAGGKRAEGPTATTSPGTVASGHPHSFGVVGWPPIRQFRMNSLFNQAKENTSETDTKKTATNESDVQKDKEEGEKKGRVAGWVKVNMDGEVIGRKVDLNAHRSYKTLALALELMFTKPSIGLCASHNTNSLKLLDNSAEYQLTYEDRDGDWMLVGDVPWEMFVSSVKRLRIMRTSDANGLGQRYQGIHRTIASTRGRS

SEQ ID NO: 2611 - protein, 293 aa, Zea mays
  misc_feature: Public GI ID no. 226509392
  misc_feature (1)..(293): Bit score of 47.2 for hmm based on sequences of FIGURE 23.
  misc_feature (40)..(278): Pfam Name: AUX_IAA Pfam Description: AUX/IAA family
  misc_feature: Functional Homolog Of SEQ ID NO. 1592
MRGGGAGPTAAFMSDEPPPADAEEVEENSGAEEEDEETVVEQDDDELELGLCLGSKQQQQQHPPPCRILTARDLQPRSLSPDSSVSSSSPAAGAGTAAPSKRAKADAAPNSPGTVASGHPQSFGVVGWPPIRTFRMNSLFNQAKENASEAGAKKPIVEPDMQEDKEESKKGRTVGWVKVNMEGDIIGRKVDLNAHRSYKTLASALELMFMKPSIGLCTSSSSKTLKLLDSSSEYQLTYEDRDGDWMLVGDVPWEMFVGSVKRLKIMRTSDAKGLGPRFQGSHRPTAACTRGRT

SEQ ID NO: 2612 - DNA, 1013 bp, Triticum aestivum; identical to SEQ ID NO: 1588
  misc_feature: Ceres Clone ID no. 846036
  misc_feature: Encodes the peptide sequence at SEQ ID NO. 2613

SEQ ID NO: 2613 - protein, 228 aa, Triticum aestivum; identical to SEQ ID NO: 1589
  misc_feature: Ceres Clone ID no. 846036
  misc_feature (1)..(228): Bit score of 48.8 for hmm based on sequences of FIGURE 23.
  misc_feature (13)..(214): Pfam Name: AUX_IAA Pfam Description: AUX/IAA family
  misc_feature: Functional Homolog Of SEQ ID NO. 1592
  misc_feature (50)..(50): Xaa is any aa, unknown, or other
  misc_feature (51)..(51): Xaa is any aa, unknown, or other
  misc_feature (52)..(52): Xaa is any aa, unknown, or other
  misc_feature (66)..(66): Xaa is any aa, unknown, or other
  misc_feature (67)..(67): Xaa is any aa, unknown, or other

SEQ ID NO: 2614 - DNA, 1361 bp, Panicum virgatum
  misc_feature: Ceres Clone ID no. 1791455
  misc_feature: Encodes the peptide sequence at SEQ ID NO. 2615
gtctctcccaaaacacaccccctccctcgccgcagacccgcagtcactgagccaagaacgagcagcgcgatgagaggaggagcggggcccacggtggcgtttatcgccggcgacccgcctccggatgcggcggcggaggaggaggtggaggacgacgagctggagctggggctctgcctaggctccaagaagcagcagcagcagcagcagcagcccccatcgccagcgccgtgccggatcctgacggccagggacctgcagccgggggccctgtctccggactcctccgtgtcctcctcctcccccgcagcaggggcagcggcggccagcaagagggccaaggcggatacagcgcccaacgccaccatctcgccggggacggtcgcttctggccacccacagagctttggagtggtgggatggccacccataagaactttcaggatgaacagcctattcaaccaggccaaagacaatgcttcagaggctagcaccaagaaggccgctgatgaatctgacatgcagaaagacaaggagagcgagaagaaagggcgggttgtcggttgggtgaaggtgaacatggatggagatatcattggaaggaaggtcgatcttaacgcccatcgttcgtataagactcttgcctcagcacttgagctgatgttcatgaagccatccatcagtctttacacttctagtagtgcaaagtctctgaatctattggacagctcatcggaatatcagctcacctatgaggactgggatggggattggatgctcgtcggagatgttccatgggagatgtttgtaggttcagtgaagaggctcaagatcatgagggcatcagatgctaatggtctgggttagattcttcgctctctcttcttcaacccaggcatagtaaaacatttgaaggtctgcgattccaaggggttcacagagctgcagctttcacaagagctagaacttgagaagcactgatggcgttcgatctagagagctataccactggtgaagcttgaaatttgtttcatatcacataacagcagtccgtatctttggcatagttgtgagattacttgtgtctagtggaaatagtagaagcgctgtgaaggagccacaccaccgtgttctattctattctttttacttgcccttcggtgccctctttcagggctcttctcatggctatgagcatcctccccgtctcttctgtccacactgtttttatctgaggcatggtcgcccaaagtgtcggtttttctttttttttccccttttgtgctgtggcaatagtatttgttccacttgtttcatattcatgtttatatctgaatggatgtgcaaattgttgcggtctc

SEQ ID NO: 2615 - protein, 265 aa, Panicum virgatum
  misc_feature: Ceres Clone ID no. 1791455
  misc_feature (1)..(265): Bit score of 51.9 for hmm based on sequences of FIGURE 23.
  misc_feature (25)..(265): Pfam Name: AUX_IAA Pfam Description: AUX/IAA family
  misc_feature: Functional Homolog Of SEQ ID NO. 1592
MRGGAGPTVAFIAGDPPPDAAAEEEVEDDELELGLCLGSKKQQQQQQQPPSPAPCRILTARDLQPGALSPDSSVSSSSPAAGAAAASKRAKADTAPNATISPGTVASGHPQSFGVVGWPPIRTFRMNSLFNQAKDNASEASTKKAADESDMQKDKESEKKGRVVGWVKVNMDGDIIGRKVDLNAHRSYKTLASALELMFMKPSISLYTSSSAKSLNLLDSSSEYQLTYEDWDGDWMLVGDVPWEMFVGSVKRLKIMRASDANGLG

SEQ ID NO: 2616 - DNA, 834 bp, Sorghum bicolor; identical to SEQ ID NO: 1586
  misc_feature: Ceres Annot ID no. 8682232
  misc_feature: Encodes the peptide sequence at SEQ ID NO. 2617

SEQ ID NO: 2617 - protein, 277 aa, Sorghum bicolor; identical to SEQ ID NO: 1587
  misc_feature: Ceres Annot ID no. 8682232
  misc_feature (1)..(277): Bit score of 52.1 for hmm based on sequences of FIGURE 23.
  misc_feature (40)..(277): Pfam Name: AUX_IAA Pfam Description: AUX/IAA family
  misc_feature: Functional Homolog Of SEQ ID NO. 1592

SEQ ID NO: 2618 - DNA, 1013 bp, Triticum aestivum; identical to SEQ ID NO: 1588
  misc_feature: Ceres Clone ID no. 846036
  misc_feature: Encodes the peptide sequence at SEQ ID NO. 2619

SEQ ID NO: 2619 - protein, 228 aa, Triticum aestivum; identical to SEQ ID NO: 1589
  misc_feature: Ceres Clone ID no. 846036
  misc_feature (1)..(228): Bit score of 48.8 for hmm based on sequences of FIGURE 23.
  misc_feature (13)..(214): Pfam Name: AUX_IAA Pfam Description: AUX/IAA family
  misc_feature: Functional Homolog Of SEQ ID NO. 1592
  misc_feature (50)..(50): Xaa is any aa, unknown, or other
  misc_feature (51)..(51): Xaa is any aa, unknown, or other
  misc_feature (52)..(52): Xaa is any aa, unknown, or other
  misc_feature (66)..(66): Xaa is any aa, unknown, or other
  misc_feature (67)..(67): Xaa is any aa, unknown, or other

SEQ ID NO: 2620 - protein, 158 aa, Zea mays
  misc_feature: Public GI ID no. 238014206
  misc_feature (1)..(158): Bit score of 34.2 for hmm based on sequences of FIGURE 23.
  misc_feature (2)..(143): Pfam Name: AUX_IAA Pfam Description: AUX/IAA family
  misc_feature: Functional Homolog Of SEQ ID NO. 1592
MNSLFNQAKENASEAGAKKPIVEPDMQEDKEESKKGRTVGWVKVNMEGDIIGRKVDLNAHRSYKTLASALELMFMKPSIGLCTSSSSKTLKLLDSSSEYQLTYEDRDGDWMLVGDVPWEMFVGSVKRLKIMRTSDAKGLGPRFQGSHRPTAACTRGRT

SEQ ID NO: 2621 - protein, 190 aa, Glycine max
  misc_feature (1)..(190): Bit score of 477.5 for hmm based on sequences of FIGURE 23.
  misc_feature (2)..(183): Pfam Name: AUX_IAA Pfam Description: AUX/IAA family
  misc_feature: Functional Homolog Of SEQ ID NO. 1592
  misc_feature (1)..(190): in Figure 23
MESNTSRFLLNSSTLHSVFYQEKQDDGIIDLGLSLGTVRHEAYHSSANLYDEELMDWPHSNLNLKNSRTMHSRSVHQNFDEEIEGVQSNERWAYVKVNMDGVTIGRKICVLDHGGYSSLALQLEDMFGSQSVSGLRLFQSGSEYSLFYKDRQDNWRPVGDVPWKEFIECVKRLRIARKNSGIVSYSSRCT

SEQ ID NO: 2622 - protein, 153 aa, Arabidopsis lyrata subsp. lyrata
  misc_feature: Public GI ID no. 297849932
  misc_feature (1)..(153): Bit score of 394.3 for hmm based on sequences of FIGURE 23.
  misc_feature (3)..(152): Pfam Name: AUX_IAA Pfam Description: AUX/IAA family
  misc_feature: Functional Homolog Of SEQ ID NO. 1592
  misc_feature (1)..(153): in Figure 23
MDSDQHGVFPSSPKYHPYYPQNTECGGVIDLGLSLRTIQHEIYHTSGQKYCSNEGYRRNWGYVKVTMDGFVVGRKVCVLDHGGYSTLAHQLEDMFGMQSVSGLRLFQMESEFCLVYRDEEGIWRNVGDVPWNEFIETVERLRITRRNDVILPF

SEQ ID NO: 2623 - protein, 160 aa, Populus trichocarpa
  misc_feature: Public GI ID no. 224108407
  misc_feature (1)..(160): Bit score of 404.9 for hmm based on sequences of FIGURE 23.
  misc_feature (2)..(154): Pfam Name: AUX_IAA Pfam Description: AUX/IAA family
  misc_feature: Functional Homolog Of SEQ ID NO. 1592
  misc_feature (1)..(160): in Figure 23
MDSNASGFLLNPPALHSTYYQPREDDGIIDLGLSLRTLKPEAYHPSGHRMPLAEGVQSKDRWAYVKVNMDGVIVGRKICMLDHGGYSSLALQLEDMFGRQSASGLRLFQAGSEFCLFYKDREENWRTVGDVPWKEFVESVKRLRIARKSEPLLPYSPAFS
